US008193331B2

(12) United States Patent
Tsukada

(10) Patent No.: US 8,193,331 B2
(45) Date of Patent: Jun. 5, 2012

(54) PROBE SET AND METHOD FOR IDENTIFYING HLA ALLELE

(75) Inventor: Mamoru Tsukada, Fujisawa (JP)

(73) Assignee: Canon Kabushiki Kaisha, Tokyo (JP)

( * ) Notice: Subject to any disclaimer, the term of this patent is extended or adjusted under 35 U.S.C. 154(b) by 1215 days.

(21) Appl. No.: 10/582,327

(22) PCT Filed: Dec. 24, 2004

(86) PCT No.: PCT/JP2004/019763
§ 371 (c)(1),
(2), (4) Date: Jun. 9, 2006

(87) PCT Pub. No.: WO2005/063985
PCT Pub. Date: Jul. 14, 2005

(65) Prior Publication Data
US 2010/0028861 A1 Feb. 4, 2010

(30) Foreign Application Priority Data

| Dec. 25, 2003 | (JP) | 2003-430553 |
|---|---|---|
| Dec. 25, 2003 | (JP) | 2003-430554 |
| Dec. 25, 2003 | (JP) | 2003-430555 |
| Dec. 25, 2003 | (JP) | 2003-430556 |
| Dec. 25, 2003 | (JP) | 2003-430557 |
| Dec. 25, 2003 | (JP) | 2003-430558 |
| Dec. 25, 2003 | (JP) | 2003-430559 |

(51) Int. Cl.
*C07H 21/04* (2006.01)
*C07H 21/02* (2006.01)
*C12Q 1/68* (2006.01)
*C12P 19/34* (2006.01)

(52) U.S. Cl. .......... 536/24.3; 536/23.1; 536/24.33; 435/6; 435/6.11; 435/91.1

(58) Field of Classification Search .......... 435/6, 91.1, 435/183, 6.1, 6.11; 436/94, 501; 536/23.1, 536/24.3, 24.33, 25.3
See application file for complete search history.

(56) References Cited

U.S. PATENT DOCUMENTS

| 5,939,542 | A | 8/1999 | Kawai et al. | |
|---|---|---|---|---|
| 5,976,789 | A | 11/1999 | Allibert et al. | |
| 6,476,215 | B1 | 11/2002 | Okamoto et al. | 536/25.3 |
| 2003/0165884 | A1 | 9/2003 | Chow et al. | |
| 2004/0241643 | A1 | 12/2004 | Yamamoto et al. | 435/5 |
| 2005/0143930 | A1 | 6/2005 | Tsukada | 702/19 |
| 2005/0239119 | A1 | 10/2005 | Tsukada | 435/6 |
| 2007/0099187 | A1 | 5/2007 | Tsukada | 435/6 |

FOREIGN PATENT DOCUMENTS

| EP | 0 540 997 | 5/1993 |
|---|---|---|
| EP | 0 575 845 | 12/1993 |
| EP | 1 291 440 | 3/2003 |
| JP | 6-78800 | 3/1994 |
| JP | 6-90757 A | 4/1994 |
| JP | 6-505625 A | 6/1994 |
| JP | 6-303998 A | 11/1994 |
| JP | 8-308596 A | 11/1996 |
| JP | 10-506541 A | 6/1998 |
| JP | 11-187900 | 7/1999 |
| JP | 11-216000 | 8/1999 |
| JP | 2000-511430 A | 9/2000 |
| WO | 92/10589 A1 | 6/1992 |
| WO | 00/79006 | 12/2000 |
| WO | 01/77372 | 10/2001 |
| WO | 03-027309 | 4/2003 |
| WO | 03/027390 | 4/2003 |
| WO | 03/034029 | 4/2003 |
| WO | 2005/001123 | 1/2005 |
| WO | 2005/052189 | 6/2005 |

OTHER PUBLICATIONS

Bodmer et al., Identification of HLA-DP polymorphism with DP alpha and DP bata probes and monoclonal antibodies: correlation with primed lymphocyte typing. Proc. Natl. Acad. Sci. USA, 84, 4596-4600, 1987.*
Holbeck et al., Exon-specific oligonucleotide probes localize HLA-DQ beta allelic polymorphisms. Immunogenetics, 24, 251-258, 1986.*
Wordsworth et al., HLA-DR typing using DNA amplification by the polymerase chain reaction and sequential hybridization to sequence-specific oligonucleotide probes. Immunogenetics, 32, 413-418, 1990.*
Tian et al., MICA genetic polymorphism and linkage disequilibrium with HLA-B in 29 african-american families. Immunogenetics, 53, 724-728, 2001.*
The sequencing comparison between SEQ ID No. 251 and human Neurl1B mRNA. Printed on Jun. 21, 2010.*
The sequencing comparison between SEQ ID No. 252 and human FLJ45422 mRNA. Printed on Jun. 21, 2010.*
Duby et al., Using Synthetic Oligonucleotides as Probes. Current Protocol in Molecular Biology, supplement 2, 6.4.1 to 6.4.10, 1993.*
Rafael Arguello, et al., "A novel method for simultaneous high resolution identification of HLA-A, HLA-B, and HLA-Cw alleles", Proc. Natl. Acad. Sci., vol. 93, Oct. 1996, pp. 10961-10965.
Dan Barouch, et al., "HLA-A2 Subtypes Are Functionally Distinct in Peptide Binding and Presentation", J. Exp. Med., vol. 182, No. 6, Dec. 1995, pp. 1847-1856.
Anthony S. Carter, et al., "Nested Polymerase Chain Reaction With Sequence-Specific Primers Typing for HLA-A, -B, and -C Alleles: Detection of Microchimerism in DR-Matched Individuals", Blood, vol. 94, No. 4, Aug. 15, 1999, pp. 1471-1477.
U. Shankarkumar, et al., "Novel HLA Class I Alleles Associated with Indian Leprosy Patients", Journal of Biomedicine and Biotechnology, vol. 2003, No. 3, 2003, pp. 208-211.
Chunxia Yan, et al., "HLA-A Gene Polymorphism Defined by High-Resolution Sequence-Based Typing in 161 Northern Chinese Han People", Geno., Prot. & Bioinfo., vol. 1, No. 4, Nov. 2003, pp. 304-309.

(Continued)

Primary Examiner — Frank W Lu
(74) Attorney, Agent, or Firm — Fitzpatrick, Cella, Harper & Scinto

(57) ABSTRACT

Provided is a probe set that is useful for identifying each allele of HLA individually, and a method of identification of an allele of HLA by the use thereof for each type. The probe set is composed of probes that cover all of the partial sequences that contain a unique base to each allele. Using this probe set HLA contained in a specimen is identified.

1 Claim, No Drawings

OTHER PUBLICATIONS

Mei Han, et al., "Multiplex Single Nucleotide Extension: A Robust and High Throughput Method for HLA-A Locus Typing", Human Immunology, vol. 64, 2003, pp. 1111-1122.

Peter Parham, et al., "Diversity and Diversification of HLA-A, B, C Alleles", Journal of Immunology, vol. 142, No. 11, 1989, pp. 3937-3950.

Erik Rozemuller, "Reference Panels for Sequence Based Typing: Selection Criteria for HLA-A and HLA-B", International Histocompatibility Workling Group, http://www.ihwg.org/manual/TMcontents.htm, retreived Jul. 5, 2004.

Timothy A. Worrall, et al., "Allele-Specific HLA-DR Typing by Mass Spectrometry: An Alternative to Hybridization-Based Typing Methods", Anal. Chem., vol. 72, 2000, pp. 5233-5238.

European Search Report, dated Jan. 21, 2008 in European Application No. 04808113.

Result of Consultation dated Aug. 28, 2008 in European Application No. 04808113.7.

H. A. Erlich, et al., "HLA DNA Typing and Transplantation", Immunity, vol. 14, Apr. 2001, pp. 347-356.

J. -M. Tiercy, et al., "Molecular basis of HLA polymorphism implications in clinical transplantation", Transplant Immunology, vol. 9, 2002, pp. 173-180.

Official Action dated Jan. 31, 2011 in European Application No. 04 808 113.7.

Bunce, et al., "Phototyping: comprehensive DNA typing for HLA-A, B, C, DRB1, DRB3, DRB4, DRB5 & DQB1 by PCR with 144 primer mixes utilizing sequence-specific primers (PCR-SSP)", Tissue Antigens, vol. 46, 1995, pp. 355-367.

European Office Action dated Jan. 3, 2012 in European Application No. 04 808 113.7.

Bodmer, et al., "Nomenclature for factors of the HLA system, 1995", Tissue Antigens, vol. 46, 1995, pp. 1-18.

* cited by examiner

PROBE SET AND METHOD FOR IDENTIFYING HLA ALLELE

TECHNICAL FIELD

The present invention relates to a probe set and a method for identifying an allele of human HLA.

BACKGROUND ART

Human leukocyte antigen (HLA) is known to include multiple HLA types, such as HLA-A, HLA-B, HLA-C, HLA-DP, HLA-DQ, HLA-DR, and HLA-MICA. An HLA allele is designated with a four or more digit number by the WHO HLA Nomenclature Committee. The principle of the nomenclature is that the first two digits correspond to the serotypes; the third and fourth digits distinguish the alleles of different amino acid sequences (subtypes); and the fifth digit distinguishes the alleles of different base sequences but encoding the same amino acid sequence. Typing of these alleles has been conventionally conducted at the serological level. Although this serological method does not require special sample processing, and enables easy typing using antigen-antibody reaction, the serotypes are the roughest classification corresponding to the first two digits of the numbers according to the nomenclature described above.

Many of other commercially available kits of the type associated with genomic extraction do not have enough accuracy to identify each allele individually. It is the current state that such a kit distinguishes multiple alleles as a group. Moreover, even a kit based on the SBT (Sequencing Based Typing) method, which enables the most detailed polymorphic analysis, often fails to solve the problem of ambiguity by one analysis since most samples are heterozygotes requiring reexamination. Such problematic alleles are listed collectively in http://www.ihwg.org/protocols/sbt/ambiguities2.pdf by the International Histocompatibility Working Group (IHWG).

DISCLOSURE OF INVENTION

On the other hand, with the development of advanced medical treatment in recent years, detailed HLA typing is required in organ transplantation, etc. In addition, associations of HLA with diabetes, cancer, and other multifactorial diseases have been suggested. With such a background, a test method is desired that can identify each allele individually. Upon such demands it is an object of the present invention to provide a probe set that is useful for identifying each allele of HLA individually, and a method for identification of an HLA allele by the use thereof.

A probe set for identifying an allele of HLA according to the present invention is a probe set comprising multiple probes that can be used for identifying HLA allele contained in a specimen, characterized in that each of the multiple probes comprises a partial sequence containing a base represented by a capital letter in a sequence of each allele in an allele list in the description.

An embodiment of the present invention is a probe set comprising multiple probes that can be used for identification of an HLA-A allele in a specimen, characterized in that each of the multiple probes comprises a partial sequence containing a base represented by a capital letter in a sequence of each allele in an allele list in the description.

Another embodiment of the present invention is a method for identification of an HLA-A allele contained in a specimen using a probe set, characterized in that the probe set is the probe set described above.

Another embodiment of the present invention is a probe set comprising multiple probes that can be used for identification of an HLA-B allele in a specimen, characterized in that each of the multiple probes comprises a partial sequence containing a base represented by a capital letter in a sequence of each allele in an allele list in the description.

Another embodiment of the present invention is a method for identification of an HLA-B allele contained in a specimen using a probe set, characterized in that the probe set is the probe set described above.

Another embodiment of the present invention is a probe set comprising multiple probes that can be used for identification of an HLA-C allele in a specimen, characterized in that each of the multiple probes comprises a partial sequence containing a base represented by a capital letter in a sequence of each allele in an allele list in the description.

Another embodiment of the present invention is a method for identification of an HLA-C allele contained in a specimen using a probe set, characterized in that the probe set is the probe set described above.

Another embodiment of the present invention is a probe set comprising multiple probes that can be used for identification of an HLA-DP allele in a specimen, characterized in that each of the multiple probes comprises a partial sequence including a base represented by a capital letter in the sequence of each allele in the allele list in the description.

Another embodiment of the present invention is a method for identification of an HLA-DP allele contained in a specimen using a probe set, characterized in that the probe set is the probe set described above. Another embodiment according to the present invention is a probe set for identification of an HLA-DQ allele that is a probe set comprising multiple probes that can be used for identification of an HLA-DQ allele in a specimen, characterized in that each of the multiple probes comprises a partial sequence containing a base represented by a capital letter in a sequence of each allele in an allele list in the description.

Another embodiment of the present invention is a probe set comprising multiple probes that can be used for identification of an HLA-DQ allele in a specimen, characterized in that each of the multiple probes comprises a partial sequence containing a base represented by a capital letter in a sequence of each allele in an allele list in the description.

Another embodiment of the present invention is a method for identification of an HLA-DQ allele contained in a specimen using a probe set, characterized in that the probe set is the probe set described above.

Another embodiment of the present invention is a probe set comprising multiple probes that can be used for identification of an HLA-DR allele in a specimen, characterized in that each of the multiple probes comprises a partial sequence containing a base represented by a capital letter in a sequence of each allele in an allele list in the description.

Another embodiment of the present invention is a method for identification of an HLA-DR allele contained in a specimen using a probe set, characterized in that the probe set is the probe set described above.

Another embodiment of the present invention is a probe set comprising multiple probes that can be used for identification of an HLA-MICA allele in a specimen, characterized in that each of the multiple probes comprises a partial sequence containing a base represented by a capital letter in a sequence of each allele in an allele list in the description.

Another embodiment of the present invention is a method for identification of an HLA-MICA allele contained in a specimen using a probe set, characterized in that the probe set is the probe set described above.

The probe set according to the present invention, and identification of an allele of each HLA type by the use thereof can contribute to diathesis diagnoses and tailor-made medicines, which are required in organ transplantation, cancer, diabetes, and other multifactorial diseases.

Other features and advantages of the present invention will be apparent from the following description.

BEST MODE FOR CARRYING OUT THE INVENTION

Preferred embodiments of the present invention will now be described in detail. Each probe that constitutes the probe set of the present invention has a partial sequence including a base represented by a capital letter in each allele sequence in the allele lists described later. Preferably, segments consisting of 10 to 30 bases including a base represented by a capital letter are selected from each allele sequence, and the probe set is composed of probes having the obtained partial base sequences respectively. As specific examples, the following compositions can be employed:

1) A probe set for HLA-A allele identification consisting of respective probes listed in one of the probe list A1 shown in Tables 1-1 to 1-7 and the probe list A2 shown in Tables 2-1 to 2-6 shown later;

2) A probe set for HLA-B allele identification consisting of probes listed in one of the probe list B1 shown in Tables 5-1 to 5-9 and the probe list B2 shown in Tables 6-1 to 6-8 shown later;

3) A probe set for HLA-C allele identification consisting of probes listed in one of the probe list C1 shown in Tables 9 and the probe list C2 shown in Table 10 shown later;

4) A probe set for HLA-DP allele identification consisting of probes listed in one of the probe lists DP1-DP4 shown in Tables 13-1 to 16-5 respectively as shown later;

5) A probe set for HLA-DQ allele identification consisting of probes listed in one of the probe lists DQ1 to DQ4 shown in Tables 17A, 17B-1, 17B-2, 18A, 18B-1 and 18B-2 respectively as shown later;

6) A probe set for HLA-DR allele identification consisting of probes listed in one of the probe lists DR1 and DR2 shown in Tables 21-1 to 21-8 and Tables 22-1 to 22-7 respectively, as shown later; and 7) A probe set for HLA-MICA allele identification consisting of probes listed in one of the probe lists MICA1 and MICA2 shown in Tables 25-1, 25-2 and Tables 26-1 to 26-2 respectively, as shown later.

For example, the No. 0 probe in the probe list A1 has a 16-base sequence of "gccccgcttcatcgcC", which is a segment containing the first capital lettered base C in A*010101, and the No. 0 probe in the probe list 2 has an 18-base sequence of "cttcatcgcCgtgggcta", which is a segment also containing the first capital lettered base C in the same allele.

In the allele list, each allele is assigned with a unique number such as "A*xxxx" in accordance with "allele nomenclature" by Japanese Society for Histocompatibility and Immunogenetics, HLA Standardization Committee.

To identify an allele using a probe set according to the present invention, two methods are possible: one is detection by hybridization; and the other is direct detection by PCR without hybridization. In either method, each probe is an oligonucleotide of preferably more than 10 and less than 30 nucleotides in length and designed to include the base represented by a capital letter, i.e., a base specific for the allele to be identified.

Moreover, the probe arrays provided in the present invention present groups of varied bases for identification of each allele individually by positions chosen for the probes. As a method for detection of such a varied base, the detection method by hybridization, and the method of direct detection by PCR without hybridization can also be preferably used. Also in these cases, the probes are designed as oligonucleotides of preferably more than 10 and less than 30 nucleotides in length each containing a base represented by a capital letter.

When a variation is detected by hybridization, probes are preferably designed to have a variant base represented by a capital letter near the center of the probes, which makes Tm difference between full-matched and mismatched pairs larger, enabling easier separation of them by adjusting the reaction temperature of hybridization.

On the other hand, when the variation is directly detected by PCR, the variant base is rather placed near the 3' end so that enzymatic recognition and elongation of annealed double strands will not occur. Also, some variation methods are possible, such as a method placing a variant base at the second from the 3' end an artificial variant base at the third from the 3' end as with Allele Specific Primer (Toyobo Co., Ltd.); a method circularizing probes by ligation with a mismatch placed near the 3' end (Amersham Biosciences Co., Ltd.); TaqMan-MGB (ABI Co.); and 3'-end mismatch using LNA (Proligo Japan Co., Ltd.).

For example, a segment including the fourth capital letter of A*2302 is "ggagcagTggagagC", and the corresponding segment of A*2303 of the same serotype is "ggagcagtTgagagc", differing at the ninth base. By using a probe with a sequence of one of these segments, one can be distinguished from the other by mismatching.

EXAMPLES

The present invention will be described further by way of examples in the following.

Example 1

Probes for Identification of HLA-A Allele

Extraction of DNA from 1 ml of human blood was performed using GFX Genomic Blood DNA Purification Kit from Amersham Biosciences. The protocol is as follows:
Blood 1 ml→
Add RBC Lysis Solution [hemolysate]→
Mix gently at room temperature for 5 minutes→
Centrifuge at 12,000-16,000×g for 20 seconds→
Discard the supernatant leaving 20-50 μl→
Resuspend the precipitation→
Add Extraction Solution and vortex vigorously→
Stand at room temperature for 5 minutes [extraction of DNA]→
Set a GFX Column in a Collection Tube→
Heat the elusion buffer to 70° C.→
Add the sample→
Centrifuge at 5,000×g for 1 minute (binding of DNA)→
Add Extraction Solution (washing)→
Centrifuge at 5,000×g for 1 minute→
Add Washing Solution (washing)→
Centrifuge at 12,000×g for 3 minutes→
Set a GFX Column in a centrifugal tube→
Eluate with pure water→
Stand at room temperature for 1 minute→
Centrifuge at 5,000-8,000×g for 1 minute→
Concentrate to 230 μl . . . solution (1).

Next, quantitative PCR was carried out using QuantiTect SYBR Green PCR Kit from QIAGEN and GeneAmp5700 from ABI. The reaction composition and the protocol are shown below.

1) Reaction Composition/Well (96 Well Microplate)
  QuantiTect SYBR Green 2× premix: 10 μl
  Solution (1): 1 μl
  Solution of one of the probes in the probe list A1 (10 pmol/μl): 1 μl
  Mixed primers (10 pmol/μl)*: 3 μl
  Ultra pure water: 5 μl
  (Total: 20 μl)
    *consisting of 1 μl each of the solutions respectively containing probes of the following sequences at 10 pmol/μl:

```
CCCATCTCAGGGTGAGGGGCT    (SEQ ID NO: 632)

GCGCTGCAGCGTCTCCTTCC     (SEQ ID NO: 633)

GCCCAGGTCTGGGTCAGGGCCAG  (SEQ ID NO: 634)
```

2) PCR Program
  94° C.: 180 sec followed by 30 cycles of [94° C.: 10 sec→66° C.: 10 sec→72° C.: 20 sec.].
  Referring to Amp Plot and Dissociation curves on a display of 5700 software, and to the allele-probe correspondence list A1 (Tables 3-1 to 3-9), it was identified as A*2402101.

Example 2

Extraction of DNA from 1 ml of human blood was performed in the same manner as in Example 1. PCR of human HLA-A was then performed using ABI 9700 PCR Instrument and Ex Taq from Takara Bio Inc. The reaction composition and the protocol are as follows:

1) Reaction Composition/Tube
  Ex Taq 2×premix: 20 μl
  Solution (1): 3 μl
  Cy-3 dUTP (1 mM): 2 μl
  Mix primer (10 pmol/μl)*: 3 μl
  Ultra pure water: 12 μl
  (Total: 40 μl)
    *consisting 1 μl each of the solutions respectively containing probes of the following sequences at 10 pmol/μl:

```
ATGGCTCCCCGAACCCTC       (SEQ ID NO: 635)

ATGGCGCCCCGAACCCTC       (SEQ ID NO: 636)

CATCTCAGGGTGAGGGGCT      (SEQ ID NO: 637)
```

2) PCR program
  94° C.: 180 sec followed by 30 cycles of [94° C.: 10 sec→66° C.: 10 sec→72° C.: 20 sec]
  After the completion of the reaction, unreacted dNTPs, etc., were removed using a purification column (QIAGEN QIAquick PCR Purification Kit) to obtain a sample.

At the same time, a DNA microarray was prepared to identify the allele in the specimen described above. The method for the preparation was in accordance with examples in Japanese Patent Application Laid-Open No. H11-187900. SH group was used as the functional group for immobilization. A glass substrate was treated by a silane-coupling agent to bind the SH group of the probes via a divalent reagent EMCS (N-(6-maleimidocaproyloxy)succinimide). Each probe in the probe list A2 was used for each dot.

The DNA microarray was blocked in advance with PBS supplemented with 1 wt % of BSA (bovine serum albumin) for two hours. The sample was adjusted to have a salt concentration equal to that of the PBS, and to contain 0.1 wt % of SDS (sodium dodecyl sulfate) and 25% of formamide.

Then, hybridization was performed using the above sample (PCR product) and the prepared DNA microarray. 50 μl of the sample was reacted with the blocked DNA microarray at 60° C. for 2 hours. Unreacted substances were washed off by washing three times with 2×SSC solution (NaCl 300 mM, Sodium Citrate (trisodium citrate dihydrate, $C_6H_5Na_3.2H_2O$) 30 mM, pH 7.0), followed by washing twice with 0.1×SSC solution. The DNA microarray was air-dried and the fluorometry measurement was conducted using GenePix4000B made by Axon. Referring to the allele-probe list A2 (Tables 4-1 to 4-9), the sample was identified as A*2402101.

```
A*010101:
                                                          (SEQ ID NO: 1)
atggccgtcatggcgccccgaaccctcctcctgctactctcggggccctggccctgacccagacctgggcgggct cccactccatgagggtatttcttcacatccgtgtcccggcccggccgcggggagccccgcttcatcgcCgtgggcta cgtggacgacacgcagttcgtgcggttcgacagcgacgccgcgagccagaagatggagccgcgggcgccgtggata gagcaggaggggccggagtattgggaccaggagacacggaatAtgaaggcccactcacagactgaccgagcgaacc tggggaccctgcgcggctactacaaccagagcgaggacggttctcacaccatccagataatgtatggctgcgacgt ggggccggacgggcgcttcctccgcgggtaccggcaggacgcctacgacggcaaggattacatcgccctgaacgag gacctgcgctcttggaccgcggcggacatggcagctcagatcaccaagcgcaagtgggaggcggtccatgcggcgg agcagcggagagTctacctggagggcCGgtgcgtggacgggctccgcagatacctggagaacgggaaggagacgct gcagcgcacggaccccccaagacacatatgacccaccacccatctctgaccatgaggccaccctgaggtgctgg gccctgGgcttctaccctgcggagatcacactgacctggcagcgggatggggaggaccagacccaggacacggagc tcgtggagaccaggcctgcaggggatggaaccttccagaagtgggcggctgtggtggtGccttctggaGaggagca gagatacacctgccatgtgcagcatgagggtctgcccaagcccctcaccctgagatgggag;
```

-continued

A*010102:

(SEQ ID NO: 2)

gctcccactccatgaggtatttcttcacatccgtgtcccggcccggccgcggggagccccgcttcatcgccgtggg ctacgtggacgacacgcagttcgtgcggttcgacagcgacgccgcgagccagaagatggagccgcgggcgccgtgg atagagcaggaggggccggagtattgggaccaggagacacggaatatgaaggcccactcacagactgaccgagcga acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatTaccaagcgcaagtgggaggcggtccatgcgg cggagcagcggagagtctacctggagggccggtgcgtggacgggctccgcagatacctggagaacgggaaggagac gctgcagcgcacgg;

A*0102:

(SEQ ID NO: 3)

atggccgtcatggcgccccgaaccctcctcctgctactctcgggggccctggccctgacccagacctgggcgggct cccactccatgaggtatttctCcacatccgtgtcccggcccggcagtggAgagcccgcttcatcgcagtgggcta cgtggacgacacgcagttcgtgcggttcgacagcgacgccgcgagccagaagatggagccgcgggcgccgtggata gagcaggaggggccggagtattgggaccaggagacacggaatatgaaggcccactcacagactgaccgagcgaacc tggggaccctgcgcggctactacaaccagagcgaggacggttctcacaccatccagataatgtatggctgcgacgt ggggccggacgggcgcttcctccgcgggtaccggcaggacgcctacgacggcaaggattacatcgccctgaacgag gacctgcgctcttggaccgcggcggacatggcagctcagatcaccaagcgcaagtgggaggcggtccatgcggcgg agcagcggagagtctacctggagggccggtgcgtggacgggctccgcagatacctggagaacgggaaggagacgct gcagcgcacggaccccccaagacacatatgacccaccacccatctctgaccatgaggccaccctgaggtgctgg gccctgggcttctaccctgcggagatcacactgacctggcagcgggatggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatgggag

A*0103:

(SEQ ID NO: 4)

gctcccactccatgaggtatttcttcacatccgtgtcccggcccggccgcggggagccccgcttcatcgccgtggg ctacgtggacgacacgcagttcgtgcggttcgacagcgacgccgcgagccagaagatggagccgcgggcgccgtgg atagagcaggaggggccggagtattgggaccaggagacacggaatatgaaggcccactcacagactgaccgagcga acctggggaccctgcgcggctactacaaccagagcgaggacggttctcacaccatccagatGatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggtccatgcgg cggagcagcggagagtctacctggagggccggtgcgtggacgggctccgcagatacctggagaacgggaaggagac gctgcagcgcacgg;

A*0106:

(SEQ ID NO: 5)

gctcccactccatgaggtatttcttcacatccgtgtcccggcccggccgcggggagccccgcttcatcgccgtggg ctacgtggacgacacgcagttcgtgcggttcgacagcgacgccgcgagccagaagatggagccgcgggcgccgtgg atagagcaggaggggccggagtattgggaccaggagacacggaatatgaaggcccactcacagactgaccgagcga acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggtccatgcgg cggagcagTTgagagcctacctggagggccggtgcgtggacgggctccgcagatacctggagaacgggaaggagac gctgcagcgcacgg;

A*0107:
(SEQ ID NO: 6)

gctcccactccatgaggtatttcttcacatccgtgtcccggcccggccgcggggagccccgcttcatcgccgtggg ctacgtggacgacacgcagttcgtgcggttcgacagcgacgccgcgagccagaagatggagccgcgggcgccgtgg atagagcaggagaggccTgagtattgggaccaggagacacggaatgtgaaggcccactcacagactgaccgagAga acctggggaccctgcgcggctactacaaccagagcgaggCcggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggtccatgcgg cggagcagcggagagtctacctggagggccggtgcgtggacgggctccgcagatacctggagaacgggaaggagac gctgcagcgcacgg;

A*0108:
(SEQ ID NO: 7)

gctcccactccatgaggtatttcttcacatccgtgtcccggcccggccgcggggagccccgcttcatcgccgtggg ctacgtggacgacacgcagttcgtgcggttcgacagcgacgccgcgagccagaagatggagccgcgggcgccgtgg atagagcaggaggggccggagtattgggaccaggagacacggaatatgaaggcccactcacagactgaccgagcga acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggtccatgcgg cggagcagcggagagtctacctggagggcTggtgcgtggacgggctccgcagatacctggagaacgggaaggagac gctgcagcgcacgg;

A*0109:
(SEQ ID NO: 8)

atggccgtcatggcgccccgaaccctcctcctgctactctcgggggccctggccctgacccagacctgggcgggct cccactccatgaggtatttcttcacatccgtgtcccggcccggccgcggggagccccgcttcatcgccgtgggcta cgtggacgacacgcagttAgtgcggttcgacagcgacgccgcgagccagaagatggagccgcgggcgccgtggata gagcaggaggggccggagtattgggaccaggagacacggaatatgaaggcccactcacagactgaccgagcgaacc tggggaccctgcgcggctactacaaccagagcgaggacggttctcacaccatccagataatgtatggctgcgacgt ggggccggacgggcgcttcctccgcgggtaccggcaggacgcctacgacggcaaggattacatcgccctgaacgag gacctgcgctcttggaccgcggcggacatggcagctcagatcaccaagcgcaagtgggaggcggtccatgcggcgg agcagcggagagtctacctggagggccggtgcgtggacgggctccgcagatacctggagaacgggaaggagacgct gcagcgcacggacccccccaagacacatatgacccaccacccatctctgaccatgaggccaccctgaggtgctgg gccctgggcttctaccctgcggagatcacactgacctggcagcgggatggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatgggag;

A*020101:
(SEQ ID NO: 9)

atggccgtcatggcgccccgaaccctcgtcctgctactctcggggcTctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaAgtgaaggcccactcacagactCaccgagtggacc tggggaccctgcgcggctactacaaccagagcgaggccggttctcacaccGtccagaGgatgtatggctgcgacgt ggggtcggacTggcgcttcctccgcgggtaccaccagtacgcctacgacggcaaggattacatcgccctgaaagag gacctgcgctcttggaccgcggcggacatggcagctcagaccaccaagcacaagtgggaggcggcccatgTggcgg agcagtTgagagcctacctggagggcaCgtgcgtggagtggctccgcagatacctggagaacgggaaggagacgct gcagcgcacggacgcccccaaaacgcatatgactcaccacgctgtctctgaccatgaagccaccctgaggtgctgg -continued gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtTtgcccaagcccctcaccctgagatgggag;

A*020102:
(SEQ ID NO: 10)
gctcccactccatgaggtatttcttcacatccgtgtcccggcccggccgcggggagcccgcttcatcgcAgtggg ctacgtggacgacacgcagttcgtgcggttcgacagcgacgccgcgagccagaggatggagccgcgggcgccgtgg atagagcaggagggtccggagtattgggacgGggagacacggaaAgtgaaggcccactcacagactCaccgagtgg acctggggaccctgcgcggctactacaaccagagcgaggccggttctcacaccGtccagaGgatgtatggctgcga cgtggggtcggacTggcgcttcctccgcgggtaccaCcagTacgcctacgacggcaaggattacatcgccctgaaA gaggacctgcgctcttggaccgcggcggacatggcagctcagaCcaccaagcacaagtgggaggcggcccatgTgg cggagcagtTgagagcctacctggagggcaCgtgcgtggagTggctccgcagatacctggagaacgggaaggagac gctgcagcgcacgg;

A*020103:
(SEQ ID NO: 11)
aaccctcgtcctgctactctcgggggctctggccctgacccagacctgggcgggctctcactccatgaggtatttc ttcacatccgtgtcccggcccggccgcggggagcccgcttcatcgcagtgggctacgtggacgacacgcagttcg tgcggttcgacagcgacgccgcgagccagaggatggagccgcgggcgccgtggatagagcaggagggtccggagta ttgggacggggagacacggaaagtgaaggcccactcacagactcaTcgagtggacctggggaccctgcgcggctac tacaaccagagcgaggccggttctcacaccgtccagaggatgtatggctgcgacgtggggtcggactggcgcttcc tccgcgggtaccaccagtacgcctacgacggcaaggattacatcgccctgaaagaggacctgcgctcttggaccgc ggcggacatggcagctcagaccaccaagcacaagtgggaggcggcccatgtggcggagcagttgagagcctacctg gagggcacgtgcgtggagtggctccgcagatacctggagaacgggaaggagacgctgcagcgcacggacgccccca aaacgcatatgactcaccacgctgtctctgaccatgaagccaccctgaggtgctgggccctgagcttctaccctgc ggagatcacactgacctggcagcgggatggggaggaccagacccaggacacggagctcgtggagaccaggcctgca ggggatggaaccttccagaagtgggcggctgtggtggtgccttctggacaggagcagagatacacctgccatgtgc agcatgagggtttgcccaagcccctcaccctgagatggg;

A*020104:
(SEQ ID NO: 12)
gctctcactccatgaggtatttcttcacatccgtgtcccggcccggccgcggggagcccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcAgcggacatggcagctcagaccaccaagcacaagtgggaggcggcccatgtgg cggagcagttgagagcctacctggagggcacgtgcgtggagtggctccgcagatacctggagaacgggaaggagac gctgcagcgcacgg A*020105:
(SEQ ID NO: 13)
gctctcactccatgaggtatttcttcacatccgtgtcccggcccggccgcggggagcccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa -continued gaAgacctgcgctcttggaccgcggcggacatggcagctcagaccaccaagcacaagtgggaggcggcccatgtgg cggagcagttgagagcctacctggagggcacgtgcgtggagtggctccgcagatacctggagaacgggaaggagac gctgcagcgcacggacgcccccaaaacgcatatgactcaccacgctgtctctgaccatgaagccaccctgaggtgc tgggccctgagcttctaccctgcggagatcacactgacctggcagcgggatggggaggaccagacccaggacacgg agctcgtggagaccaggcctgcaggggatggaaccttccagaagtgggcggctgtggtggtgccttctggacagga gcagagatacacctgccatgtgcagcatgagggtttgcccaagcccctcaccctgagatggg

A*020106:

(SEQ ID NO: 14)
gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtatttgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgAttcctccgcgggtaccaccagtacgcctacgacggcaaggattacatcgccctgaaa gaggacctgcgctcttggaccgcggcggacatggcagctcagaccaccaagcacaagtgggaggcggcccatgtgg cggagcagttgagagcctacctggagggcacgtgcgtggagtggctccgcagatacctggagaacgggaaggagac gctgcagcgcacggacgcccccaaaacgcatatgactcaccacgctgtctctgaccatgaagccaccctgaggtgc tgggccctgagcttctaccctgcggagatcacactgacctggcagcgggatggggaggaccagacccaggacacgg agctcgtggagaccaggcctgcaggggatggaaccttccagaagtgggcggctgtggtggtgccttctggacagga gcagagatacacctgccatgtgcagcatgagggtttgcccaagcccctcaccctgagatggg

A*020107:

(SEQ ID NO: 15)
gctctcactccatgaggtatttcttcacatccgtgtcccggcccggccgTggggagccccgcttcatcgcagtggg ctacgtggacgacacgcagttcgtgcggttcgacagcgacgccgcgagccagaggatggagccgcgggcgccgtgg atagagcaggagggtccggagtatttgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcacaagtgggaggcggcccatgtgg cggagcagttgagagcctacctggagggcacgtgcgtggagtggctccgcagatacctggagaacgggaaggagac gctgcagcgcacggacgcccccaaaacgcatatgactcaccacgctgtctctgaccatgaagccaccctgaggtgc tgggccctgagcttctaccctgcggagatcacactgacctggcagcgggatggggaggaccagacccaggacacgg agctcgtggagaccaggcctgcaggggatggaaccttccagaagtgggcggctgtggtggtgccttctggacagga gcagagatacacctgccatgtgcagcatgagggtTtgcccaagcccctcaccctgagatggg

A*020108:

(SEQ ID NO: 16)
gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtatttgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcacaagtgggaggcggcccatgtgg cggagcagttgagagcctacctggagggcacgtgcgtggagtggctccgcagatacctggagaacgggaaggagac gctgcagcgcacggacgcccccaaaacgcatatgactcaccacgctgtctctgaccatgaagccaccctgaggtgc tgggccctgagcttctaccctgcggagatcacactgacctggcagcgggatggggaggaccagacccaggacacAg -continued agctcgtggagaccaggcctgcaggggatggaaccttccagaagtgggcggctgtggtggtgccttctggacagga gcagagatacacctgccatgtgcagcatgagggtttgcccaagcccctcaccctgagatggg

A*020109:

(SEQ ID NO: 17)

gctctcactccatgaggtatttcttcacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggagggtccggagtattgggacggggagacacggaaAgtgaaggcccactcacagactCaccgagtgg acctggggaccctgcgcggctactacaaccagagcgaggccggttctcacaccGtccagaGgatgtatggctgcga cgtggggtcggacTggcgcttcctccgcgggtaccaccagtacgcctacgacggcaaggattacatcgccctgaaa gaggacctgcgctcttggaccgcggcggacatggcagctcagaccaccaagcacaagtgggaggcggcccatgTgg cggagcagTTgagagcctacctggagggcaCgtgcgtggagtggctccgcagatacctggagaacgggaaggagac gctgcagcgcacggacgcccccaaaacgcatatgactcaccacgctgtctctgaccatgaagccaccctgaggtgc tgggccctgagcttctaccctgcggagatcacactgacctggcagcgggatggggaggaccagacccaggacacgg agctcgtggagaccaggcctgcaggggatggaaccttccagaagtgggcggctgtggtggtgccttctggacagga gcagagatacacctgccatgtgcagcatgagggtTtgcccaagcccctcaccctgagatggg;

A*0202:

(SEQ ID NO: 18)

gctctcactccatgaggtatttcttcacatccgtgtcccggcccggccgcggggagccccgcttcatcgcagtggg ctacgtggacgacacgcagttcgtgcggttcgacagcgacgccgcgagccgaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccctccagaggatgtatggctgcga cgtggggtcggactggcgcttcctGcgcgggtaccaccagtacgcctacgacggcaaggattacatcgccctgaaa gaggacctgcgctcttggaccgcggcggacatggcagctcagaccaccaagcacaagtgggaggcggcccatgtgg cggagcagtggagagcctacctggagggcacgtgcgtggagtggctccgcagatacctggagaacgggaaggagac gctgcagcgcacggacgcccccaaaacgcatatgactcaccacgctgtctctgaccatgaagccaccctgaggtgc tgggccctgagcttctaccctgcggagatcacactgacctggcagcgggatggggaggaccagacccaggacacgg agctcgtggagaccaggcctgcaggggatggaaccttccagaagtgggcggctgtggtggtgccttctggacagga gcagagatacacctgccatgtgcagcatgagggtTtgcccaagcccctcaccctgagatggg;

A*0203:

(SEQ ID NO: 19)

atggccgtcatggcgccccgaaccctcgtcctgctactctcgggggcTctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaagtgaaggcccactcacagactcaccgagtggacc tggggaccctgcgcggctactacaaccagagcgaggccggttctcacaccgtccagaggatgtatggctgcgacgt ggggtcggactggcgcttcctccgcgggtaccaccagtacgcctacgacggcaaggattacatcgccctgaaagag gacctgcgctcttggaccgcggcggacatggcagctcagaccaccaagcacaagtgggagAcggcccatgAgcgg agcagTggagagcctacctggagggcaCgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtTtgcccaagcccctcaccctgagatgggag;

A*0204:

(SEQ ID NO: 20)
atggccgtcatggcgccccgaaccctcgtcctgctactctcgggggcTctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaAgtgaaggcccactcacagactCaccgagtggacc tggggaccctgcgcggctactacaaccagagcgaggccggttctcacaccGtccagatgatgtatggctgcgacgt ggggtcggacTggcgcttcctccgcgggtaccaccagtacgcctacgacggcaaggattacatcgccctgaaagag gacctgcgctcttggaccgcggcggacatggcagctcagaccaccaagcacaagtgggaggcggcccatgTggcgg agcagtTgagagcctacctggagggcaCgtgcgtggagtggctccgcagatacctggagaacgggaaggagacgct gcagcgcacggacgcccccaaaacgcatatgactcaccacgctgtctctgaccatgaagccacctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtTtgcccaagcccctcaccctgagatgggag;

A*0205:

(SEQ ID NO: 21)
atggccgtcatggcgccccgaaccctcgtcctgctactctcgggggctctggccctgacccagacctgggcgggct ctcactccatgaggtatttctacacCtccgtgtcccggcccggccgcggggagccccgcttcatcgcagtgggcta cgtggacgacacgcagttcgtgcggttcgacagcgacgccgcgagccggaggatggagccgcgggcgccgtggata gagcaggagggtccggagtattgggacggggagacacggaaagtgaaggcccactcacagactcaccgagtggacc tggggaccctgcgcggctactacaaccagagcgaggccggttctcacaccctccagaggatgtatggctgcgacgt ggggtcggactggcgcttcctGcgcgggtaccaccagtacgcctacgacggcaaggattacatcgccctgaaagag gacctgcgctcttggaccgcggcggacatggcagctcagaccaccaagcacaagtgggaggcggcccatgtggcgg agcagtggagagcctacctggagggcacgtgcgtggagtggctccgcagatacctggagaacgggaaggagacgct gcagcgcacggacgcccccaaaacgcatatgactcaccacgctgtctctgaccatgaagccacctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtTtgcccaagcccctcaccctgagatgggag;

A*0206:

(SEQ ID NO: 22)
atggccgtcatggcgccccgaaccctcgtcctgctactctcgggggcTctggccctgacccagacctgggcgggct ctcactccatgaggtatttctacacCtccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaAgtgaaggcccactcacagactCaccgagtggacc tggggaccctgcgcggctactacaaccagagcgaggccggttctcacaccGtccagaGgatgtatggctgcgacgt ggggtcggacTggcgcttcctccgcgggtaccaccagtacgcctacgacggcaaggattacatcgccctgaaagag gacctgcgctcttggaccgcggcggacatggcagctcagaccaccaagcacaagtgggaggcggcccatgTggcgg agcagtTgagagcctacctggagggcaCgtgcgtggagtggctccgcagatacctggagaacgggaaggagacgct gcagcgcacggacgcccccaaaacgcatatgactcaccacgctgtctctgaccatgaagccacctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtTtgcccaagcccctcaccctgagatgggag

A*0207:

(SEQ ID NO: 23)
atggccgtcatggcgccccgaaccctcgtcctgctactctcgggggctctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaagtgaaggcccactcacagactcaccgagtggacc tggggaccctgcgcggctactacaaccagagcgaggccggttctcacaccgtccagaggatgtGtggctgcgacgt ggggtcggactggcgcttcctccgcgggtaccaccagtacgcctacgacggcaaggattacatcgccctgaaagag gacctgcgctcttggaccgcggcggacatggcagctcagaccaccaagcacaagtgggaggcggcccatgtggcgg agcagttgagagcctacctggagggcacgtgcgtggagtggctccgcagatacctggagaacgggaaggagacgct gcagcgcacggacgcccccaaaacgcatatgactcaccacgctgtctctgaccatgaagccaccctgagtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtttgcccaagcccctcaccctgagatgggag

A*0208

(SEQ ID NO: 24)
tgggcgggctctcactccatgaggtatttctacacCtccgtgtcccggcccggccgcggggagccccgcttcatcg cagtgggctacgtggacgacacgcagttcgtgcggttcgacagcgacgccgcgagccggaggatggagccgcgggc gccgtggatagagcaggagggtccggagtattgggacggggagacacggaatgtgaaggcccactcacagactcac cgagtggacctggggaccctgcgcggctactacaaccagagcgaggccggttctcacaccctccagaggatgtatg gctgcgacgtggggtcggactggcgcttcctGcgcgggtaccaccagtacgcctacgacggcaaggattacatcgc cctgaaagaggacctgcgctcttggaccgcggcggacatggcagctcagaccaccaagcacaagtgggaggcggcc catgtggcggagcagttggagagcctacctggagggcacgtgcgtggagtggctccgcagatacctggagaacggga aggagacgctgcagcgca;

A*0209:

(SEQ ID NO: 25)
atggccgtcatggcgccccgaaccctcgtcctgctactctcgggggctctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaagtgaaggcccactcacagactcaccgagtggacc tggggaccctgcgcggctactacaaccagagcgaggccggttctcacaccgtccagaggatgtatggctgcgacgt ggggtcggactggcgcttcctccgcgggtaccaccagtacgcctacgacggcaaggattacatcgccctgaaagag gacctgcgctcttggaccgcggcggacatggcagctcagaccaccaagcacaagtgggaggcggcccatgtggcgg agcagttgagagcctacctggagggcacgtgcgtggagtggctccgcagatacctggagaacgggaaggagacgct gcagcgcacggacgcccccaaaacgcatatgactcaccacgctgtctctgaccatgaagccaccctgagtgctgg gccctgagcttctaccctgcggagatcacactgacctggcagcgggatggggaggaccagacccaggacacggagc tcgtggagaccaggcctgAaggggatggaaccttccagaagtgggcggctgtggtggtgccttctggacaggagca gagatacacctgccatgtgcagcatgagggtttgcccaagcccctcaccctgagatgggag;

A*0210:

(SEQ ID NO: 26)
atggccgtcatggcgccccgaaccctcgtcctgctactctcgggggcTctggccctgacccagacctgggcgggct ctcactccatgaggtatttctacacctccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaagtgaaggcccactcacagactcaccgagtggacc -continued tggggaccctgcgcggctactacaaccagagcgaggccggttctcacaccgtccagaGgatgtTtggctgcgacgt
ggggtcggacgggcgcttcctccgcgggtaccaccagtacgcctacgacggcaaggattacatcgccctgaaagag
gacctgcgctcttggaccgcggcggacatggcagctcagaccaccaagcacaagtgggaggcggcccatgTggcgg
agcagtTgagagcctacctggagggcaCgtgcgtggagtggctccgcagatacctggagaacgggaaggagacgct
gcagcgcacggacgcccccaaaacgcatatgactcaccacgctgtctctgaccatgaagccaccctgaggtgctgg
gccctgagcttctaccctgcggagatcacactgacctggcagcgggatggggaggaccagacccaggacacggagc
tcgtggagaccaggcctgcaggggatggaaccttccagaagtgggcggctgtggtggtgccttctggacaggagca
gagatacacctgccatgtgcagcatgagggtTtgcccaagcccctcaccctgagatgggag;

A*0211:
(SEQ ID NO: 27)
atggccgtcatggcgccccgaaccctcgtcctgctactctcgggggctctggccctgacccagacctgggcgggct
ctcactccatgaggtatttcttcacatccgtgtcccggcccggccgcggggagccccgcttcatcgcagtgggcta
cgtggacgacacgcagttcgtgcggttcgacagcgacgccgcgagccagaggatggagccgcgggcgccgtggata
gagcaggagggtccggagtattgggacggggagacacggaaagtgaaggcccactcacagaTtgaccgagtggacc
tggggaccctgcgcggctactacaaccagagcgaggccggttctcacaccgtccagaggatgtatggctgcgacgt
ggggtcggactggcgcttcctccgcgggtaccaccagtacgcctacgacggcaaggattacatcgccctgaaagag
gacctgcgctcttggaccgcggcggacatggcagctcagaccaccaagcacaagtgggaggcggcccatgtggcgg
agcagttgagagcctacctggagggcacgtgcgtggagtggctccgcagatacctggagaacgggaaggagacgct
gcagcgcacggacgcccccaaaacgcatatgactcaccacgctgtctctgaccatgaagccaccctgaggtgctgg
gccctgagcttctaccctgcggagatcacactgacctggcagcgggatggggaggaccagacccaggacacggagc
tcgtggagaccaggcctgcaggggatggaaccttccagaagtgggcggctgtggtggtgccttctggacaggagca
gagatacacctgccatgtgcagcatgagggtTtgcccaagcccctcaccctgagatgggag;

A*0212:
(SEQ ID NO: 28)
atggccgtcatggcgccccgaaccctcgtcctgctactctcgggggcTctggccctgacccagacctgggcgggct
ctcactccatgaggtatttcttcacatccgtgtcccggcccggccgcggggagccccgcttcatcgcagtgggcta
cgtggacgacacgcagttcgtgcggttcgacagcgacgccgcgagccagaggatggagccgcgggcgccgtggata
gagcaggagggtccggagtattgggacggggagacacggaaagtgaaggcccactcacagactcaccgagtggacc
tggggaccctgcgcggctactacaaccagagcgaggccggttctcacaccgtccagaggatgtatggctgcgacgt
ggggtcggactggcgcttcctccgcgggtaccaccagtacgcctacgacggcaaggattacatcgccctgaaagag
gacctgcgctcttggaccgcggcggacatggcagctcagaccaccaagcacaagtgggaggcggcccatgTggcgg
agcagcAgagagcctacctggagggcaCgtgcgtggagtggctccgcagatacctggagaacgggaaggagacgct
gcagcgcacggacgcccccaaaacgcatatgactcaccacgctgtctctgaccatgaagccaccctgaggtgctgg
gccctgagcttctaccctgcggagatcacactgacctggcagcgggatggggaggaccagacccaggacacggagc
tcgtggagaccaggcctgcaggggatggaaccttccagaagtgggcggctgtggtggtgccttctggacaggagca
gagatacacctgccatgtgcagcatgagggtTtgcccaagcccctcaccctgagatgggag;

A*0213:
(SEQ ID NO: 29)
atggccgtcatggcgccccgaaccctcgtcctgctactctcgggggcTctggccctgacccagacctgggcgggct
ctcactccatgaggtatttcttcacatccgtgtcccggcccggccgcggggagccccgcttcatcgcagtgggcta
cgtggacgacacgcagttcgtgcggttcgacagcgacgccgcgagccagaggatggagccgcgggcgccgtggata
gagcaggagggtccggagtattgggacggggagacacggaaagtgaaggcccactcacagactcaccgagtggacc
tggggaccctgcgcggctactacaaccagagcgaggccggttctcacaccgtccagaggatgtatggctgcgacgt
ggggtcggactggcgcttcctccgcgggtaccaccagtacgcctacgacggcaaggattacatcgccctgaaagag -continued gacctgcgctcttggaccgcggcggacatggcagctcagaccaccaagcacaagtgggaggcggcccatgAggcgg agcagcAgagagcctacctggagggcaCgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtTtgcccaagcccctcaccctgagatgggag;

A*0214:
(SEQ ID NO: 30)
cgtcatggcgccccgaaccctcgtcctgctactctcgggggctctggccctgacccagacctgggcgggctctcac tccatgaggtatttctacacctccgtgtcccggcccggccgcggggagccccgcttcatcgcagtgggctacgtgg acgacacgcagttcgtgcggttcgacagcgacgccgcgagccggaggatggagccgcgggcgccgtggatagagca ggagggtccggagtattgggacggggagacacggaaagtgaaggcccactcacagactcaccgagtggacctgggg accctgcgcggctactacaaccagagcgaggccggttctcacaccctccagaggatgtatggctgcgacgtgggt cggactggcgcttcctGcgcgggtaccaccagtacgcctacgacggcaaggattacatcgccctgaaagaggacct gcgctcttggaccgcggcggacatggcagctcagaccaccaagcacaagtgggaggcggcccatgtggcggagcag tTgagagcctacctggagggcacgtgcgtggagtggctccgcagatacctggagaacgggaaggagacgctgcagc gcacggacgcccccaaaacgcatatgactcaccacgctgtctctgaccatgaagccaccctgaggtgctgggccct gagcttctaccctgcggagatcacactgacctggcagcgggatggggaggaccagacccaggacacggagctcgtg gagaccaggcctgcaggggatggaaccttccagaagtgggcggctgtggtggtgccttctggacaggagcagagat acacctgccatgtgcagcatgagggtTtgcccaagcccctcaccctgagatgggag;

A*0216:
(SEQ ID NO: 31)
atggccgtcatggcgccccgaaccctcgtcctgctactctcgggggctctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaagtgaaggcccactcacagactcaccgagtggacc tggggaccctgcgcggctactacaaccagagcgaggccggttctcacaccgtccagaggatgtatggctgcgacgt ggggtcggactggcgcttcctccgcgggtaccaccagtacgcctacgacggcaaggattacatcgccctgaaagag gacctgcgctcttggaccgcggcggacatggcagctcagaccaccaagcacaagtgggaggcggcccatgtggcgg agcagttgagagcctacctggagggcgAgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtTtgcccaagcccctcaccctgagatgggag;

A*021701:
(SEQ ID NO: 32)
atggccgtcatggcTccccgaaccctcgtcctgctactctcgggggctctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaagtgaaggcccactcacagactcaccgagtggacc tggggaccctgcgcggctactacaaccagagcgaggccggttctcacaccctccagatgatgtttggctgcgacgt ggggtcggactggcgcttcctccgcgggtaccaccagtacgcctacgacggcaaggattacatcgccctgaaagag gacctgcgctcttggaccgcggcggacatggcagctcagaccaccaagcacaagtgggaggcggcccatgtggcgg -continued agcagttgagagcctacctggagggcacgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtttgcccaagcccctcaccctgagatgggag;

A*021702: (SEQ ID NO: 33)

atggccgtcatggcgccccgaaccctcgtcctgctactctcgggggcTctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaagtgaaggcccactcacagactcaccgagtggacc tggggaccctgcgcggctactacaaccagagcgaggccggttctcacaccctccagatgatgtTtggctgcgacgt ggggtcggacTggcgcttcctccgcgggtaccaccagtacgcctacgacggcaaggattacatcgccctgaaagag gacctgcgctcttggaccgcggcggacatggcagctcagaccaccaagcacaagtgggaggcggcccatgTggcgg agcagtTgagagcctacctggagggcaCgtgcgtggagtggctccgcagatacctggagaacgggaaggagacgct gcagcgcacggacgcccccaaaacgcatatgactcaccacgctgtctctgaccatgaagccaccctgaggtgctgg gccctgAgcttctaccctgcggagatcacactgacctggcagcgggatggggaggaccagacccaggacacggagc tcgtggagaccaggcctgcag;

A*0218: (SEQ ID NO: 34)

atggccgtcatggcgccccgaaccctcgtcctgctactctcgggggctctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaagtgaaggcccactcacagactcaccgagtggacc tggggaccctgcgcggctactacaaccagagcgaggccggttctcacaccgtccagaggatgtgtggctgcgacgt ggggtcggactggcgcttcctccgcgggtaccaccagtacgcctacgacggcaaggattacatcgccctgaaagag gacctgcgctcttggaccgcggcggacaAggcagctcagaccaccaagcacaagtgggaggcggcccatgtggcgg agcagttgagagcctacctggagggcacgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtttgcccaagcccctcaccctgagatgggag;

A*0219: (SEQ ID NO: 35)

gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgG acctggggaccctgcgcggctactacaaccagagcgaggccggttctcacaccGtccagaggatgtatggctgcga cgtggggtcggactggcgcttcctccgcgggtaccaccagtacgcctacgacggcaaggattacatcgccctgaaa gaggacctgcgctcttggaccgcggcggacatggcGgctcagatcaccaagcgcaagtgggaggcggcccatgTgg cggagcagcAgagagcctacctggagggcaCgtgcgtggacgggctccgcagatacctggagaacgggaaggagac gctgcagcgcacgg;

A*022001:
(SEQ ID NO: 36)
gctctcactccatgaggtatttcttcacatccgtgtcccggcccggccgcggggagccccgcttcatcgcAgtggg ctacgtggacgacacgcagttcgtgcggttcgacagcgacgccgcgagccagaggatggagccgcgggcgccgtgg atagagcaggagggtccggagtattgggacGGggagacacggaatgtgaaggcccactcacagactCaccgagtgg acctggggaccctgcgcggctactacaaccagagcgaggccggttctcacaccGtccagaGgatgtatggctgcga cgtggggtcggacTggcgcttcctccgcgggtaccaCcagTacgcctacgacggcaaggattacatcgccctgaaA gaggacctgcgctcttggaccgcggcggacatggcagctcagaCcaccaagcacaagtgggaggcggcccatgTgg cggagcagtTgagagcctacctggagggcaCgtgcgtggagTggctccgcagatacctggagaacgggaaggagac gctgcagcgcacgg;

A*022002:
(SEQ ID NO: 37)
gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaCgtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcacaagtgggaggcggcccatgtgg cggagcagttgagagcctacctggagggcacgtgcgtggagtggctccgcagatacctggagaacgggaaggagac gctgcagcgcacgg;

A*0221:
(SEQ ID NO: 38)
atggccgtcatggcgccccgaaccctcgtcctgctactctcgggggctctggccctgacccagacctgggcgggct ctcactccatgaggtatttctacacctccgtgtcccggcccggccgcggggagccccgcttcatcgcagtgggcta cgtggacAacacgcagttcgtgcggttcgacagcgacgccgcgagccagaggatggagccgcgggcgccgtggata gagcaggagggtccggagtattgggacggggagacacggaaagtgaaggcccactcacagactcaccgagtggacc tggggaccctgcgcggctactacaaccagagcgaggccggttctcacaccgtccagaggatgtatggctgcgacgt ggggtcggactggcgcttcctccgcgggtaccaccagtacgcctacgacggcaaggattacatcgccctgaaagag gacctgcgctcttggaccgcggcggacatggcagctcagaccaccaagcacaagtgggaggcggcccatgtggcgg agcagttgagagcctacctggagggcacgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtttgcccaagcccctcaccctgagatgggag;

A*0222:
(SEQ ID NO: 39)
atggccgtcatggcgccccgaaccctcgtcctgctactctcgggggcTctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaAgtgaaggcccactcacagactCaccgagtggacc tggggaccctgcgcggctactacaaccagagcgaggccggttctcacaccGtccagaGgatgtatggctgcgacgt ggggtcggacTggcgcttcctccgcgggtaccaccagtacgcctacgacggcaaggattacatcgccctgaaagag gacctgcgctcttggaccgcggcggacatggcagctcagaccaccaagcacaagtgggaggcggcccatgTggcgg agcagTggagagcctacctggagggcaCgtgcgtggagtggctccgcagatacctggagaacgggaaggagacgct -continued gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtTtgcccaagcccctcaccctgagatgggag;

A*0224:

(SEQ ID NO: 40)

gctctcactccatgaggtatttcttcacatccgtgtcccggcccggccgcggggagccccgcttcatcgcAgtggg ctacgtggacgacacgcagttcgtgcggttcgacagcgacgccgcgagccagaggatggagccgcgggcgccgtgg atagagcaggagggtccggagtattgggacgGggagacacggaaAgtgaaggcccactcacagactCaccgagtgg acctggggaccctgcgcggctactacaaccagagcgaggccggttctcacaccGtccagaGgatgtatggctgcga cgtggggtcggacTggcgcttcctccgcgggtaccaCcagTacgcctacgacggcaaggattacatcgccctgaac gaggacctgcgctcttggaccgcggcggacatggcagctcagaCcaccaagcacaagtgggaggcggcccatgTgg cggagcagtTgagagcctacctggagggcaCgtgcgtggagTggctccgcagatacctggagaacgggaaggagac gctgcagcgcacgg;

A*0225:

(SEQ ID NO: 41)

gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcacaagtgggagAcggcccatgTgg cggagcagtTgagagcctacctggagggcaCgtgcgtggagtggctccgcagatacctggagaacgggaaggagac gctgcagcgcacgg;

A*0226:

(SEQ ID NO: 42)

gtcatggcgccccgaaccctcgtcctgctactctcgggggcTctggccctgacccagacctgggcgggctctcact ccatgaggtatttcttcacatccgtgtcccggcccggccgcggggagccccgcttcatcgcagtgggctacgtgga cgacacgcagttcgtgcggttcgacagcgacgccgcgagccagaggatggagccgcgggcgccgtggatagagcag gagggtccggagtattgggacggggagacacggaaagtgaaggcccactcacagactcaccgagtggacctgggga ccctgcgcggctactacaaccagagcgaggccggttctcacaccgtccagaggatgtatggctgcgacgtggggtc ggactggcgcttcctccgcgggtaccaccagtacgcctacgacggcaaggattacatcgccctgaaagaggacctg cgctcttggaccgcggcggacatggcagctcagaccaccaagcacaagtgggaggcggcccatgAggcggagcagt TgagagcctacctggagggcaCgtgcgtggagtggctccgcagatacctggagaacgggaaggagacgctgcagcg cacggacgcccccaaaacgcatatgactcaccacgctgtctctgaccatgaagccaccctgaggtgctgggccctg agcttctaccctgcggagatcacactgacctggcagcgggatggggaggaccagacccaggacacggagctcgtgg agaccaggcctgcaggggatggaaccttccagaagtgggcggctgtggtggtgccttctggacaggagcagagata cacctgccatgtgcagcatgagggtTtgcccaagcccctcaccctgagatgggag;

A*0227:

(SEQ ID NO: 43)

gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccGtccagaggatgtatggctgcga cgtggggtcggactggcgcttcctccgcgggtaccaccagtacgcctacgacggcaaggattacatcgccctgaaa -continued gaggacctgcgctcttggaccgcggcggacatggcagctcagaccaccaagcAcaagtgggaggcggcccatgcgg cggagcagcAgagagcctacctggagggcaCgtgcgtggagTggctccgcagatacctggagaacgggaaggagac gctgcagcgcacgg;

A*0228:
(SEQ ID NO: 44)
gctctcactccatgaggtatttctacacctccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagAgtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcAcaagtgggaggcggcccatgTgg cggagcagtTgagagcctacctggagggcacgtgcgtggagTggctccgcagatacctggagaacgggaaggagac gctgcagcgcacgg;

A*0229:
(SEQ ID NO: 45)
gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggCaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcAcaagtgggaggcggcccatgtgg cggagcagttgagagcctacctggagggcacgtgcgtggagtggctccgcagatacctggagaacgggaaggagac gctgcagcgcacgg;

A*0230:
(SEQ ID NO: 46)
atggccgtcatggcgccccgaaccctcgtcctgctactctcgggggctctggccctgacccagacctgggcgggct ctcaGtccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaagtgaaggcccactcacagactcaccgagtggacc tggggaccctgcgcggctactacaaccagagcgaggccggttctcacaccgtccagaggatgtatggctgcgacgt ggggtcggactggcgcttcctccgcgggtaccaccagtacgcctacgacggcaaggattacatcgccctgaaagag gacctgcgctcttggaccgcggcggacatggcagctcagaccaccaagcacaagtgggaggcggcccatgtggcgg agcagttgagagcctacctggagggcacgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtttgcccaagcccctcaccctgagatgggag;

A*0231:
(SEQ ID NO: 47)
gctctcactccatgaggtatttcttcacatccgtgtcccggcccggccgcggggagccccgcttcatcgcagtggg ctacgtggacgacacgcagttcgtgcggttcgacagcgacgccgGgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa -continued gaggacctgcgctcttggaccgcggcggacatggcagctcagaccaccaagcacaagtgggaggcggcccatgtgg
cggagcagttgagagcctacctggagggcacgtgcgtggagtggctccgcagatacctggagaacgggaaggagac
gctgcagcgcacgg;

A*0233:

(SEQ ID NO: 48)

atggccgtcatggcgccccgaaccctcgtcctgctactctcgggggctctggccctgacccagacctgggcgggct
ctcactccatgaggtatttcttcacatccgtgtcccggcccggccgcggggagccccgcttcatcgcagtgggcta
cgtggacgacacgcagttcgtgcggttcgacagcgacgccgcgagccagaggatggagcgcgggcgccgtggata
gagcaggagggtccggagtattgggacggggagacacggaaagtgaaggcccactcacagactcaccgagtggacc
tggggaccctgcgcggctactacaaccagagcgaggccggttctcacaccgtccagaggatgtCtggctgcgacgt
ggggtcggactggcgcttcctccgcgggtaccaccagtacgcctacgacggcaaggattacatcgccctgaaagag
gacctgcgctcttggaccgcggcggacatggcagctcagaccaccaagcacaagtgggaggcggcccatgtggcgg
agcagttgagagcctacctggagggcacgtgcgtggagtggctccgcagatacctggagaacgggaaggagacgct
gcagcgcacggacgcccccaaaacgcatatgactcaccacgctgtctctgaccatgaagccaccctgaggtgctgg
gccctgagcttctaccctgcggagatcacactgacctggcagcgggatggggaggaccagacccaggacacggagc
tcgtggagaccaggcctgcaggggatggaaccttccagaagtgggcggctgtggtggtgccttctggacaggagca
gagatacacctgccatgtgcagcatgagggtttgcccaagcccctcaccctgagatgggag;

A*0234:

(SEQ ID NO: 49)

gctctcactccatgaggtatttcttcacatccgtgtcccggcccggccgcggggagccccgcttcatcgcagtggg
ctacgtggacgacacgcagttcgtgcggttcgacagcgacgccgcgagccagaggatggagccgcgggcgccgtgg
atagagcaggagggtccggagtattgggacggggagacacggaaAgtgaaggcccaGtcacagactCaccgagtgg
acctggggaccctgcgcggctactacaaccagagcgaggccggttctcacaccGtccagaGgatgtatggctgcga
cgtggggtcggacTggcgcttcctccgcgggtaccaccagtacgcctacgacggcaaggattacatcgccctgaaa
gaggacctgcgctcttggaccgcggcggacatggcagctcagaccaccaagcacaagtgggaggcggcccatgTgg
cggagcagTTgagagcctacctggagggcaCgtgcgtggagtggctccgcagatacctggagaacgggaaggagac
gctgcagcgcacggacgcccccaaaacgcatatgactcaccacgctgtctctgaccatgaagccaccctgaggtgc
tgggccctgagcttctaccctgcggagatcacactgacctggcagcgggatggggaggaccagacccaggacacgg
agctcgtggagaccaggcctgcaggggatggaaccttccagaagtgggcggctgtggtggtgccttctggacagga
gcagagatacacctgccatgtgcagcatgagggtTtgcccaagcccctcaccctgagatggg;

A*0235:

(SEQ ID NO: 50)

gctctcactccatgaggtatttcttcacatccgtgtcccggcccggccgcggggagccccgcttcatcgcagtggg
ctacgtggacgacacgcagttcgtgcggttcgacagcgacgccgcgagccagaggatggagccgcgggcgccgtgg
atagagcaggagggtccggagtattgggacggggagacacggaaAgtgaaggcccaGtcacagactgaccgagtgg
acctggggaccctgcgcggctactacaaccagagcgaggccggttctcacaccGtccagaGgatgtatggctgcga
cgtggggtcggacTggcgcttcctccgcgggtaccaCcagTacgcctacgacggcaaggattacatcgccctgaaA
gaggacctgcgctcttggaccgcggcggacatggcagctcagaCcaccaagcacaagtgggaggcggcccatgTgg
cggagcagtTgagagcctacctggagggcaCgtgcgtggagTggctccgcagatacctggagaacgggaaggagac
gctgcagcgcacgg;

A*0236:

(SEQ ID NO: 51)

gctctcactccatgaggtatttcttcacatccgtgtcccggcccggccgcggggagccccgcttcatcgcAgtggg
ctacgtggacgacacgcagttcgtgcggttcgacagcgacgccgcgagccagaggatggagccgcgggcgccgtgg
atagagcaggagggtccggagtattgggacgGggagacacggaaAgtgaaggcccactcacagactCaccgagtgg -continued acctggggaccctgcgcggctactacaaccagagcgaggccggttctcacaccGtccagaGgatgtatggctgcga cgtggggtcggacTggcgcttcctccgcgggtaccaCcagTacgcctacgacggcaaggattacatcgccctgaaA gaggacctgcgctcttggaccgcggcggacatggcagctcagaCcaccaagcacaagtggggaggcggcccatgTgg cggagcagtTgagagcctacctggagggcaCgtgcgtggacgggctccgcagatacctggagaacgggaaggagac gctgcagcgcacgg;

A*0237:
(SEQ ID NO: 52)
gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccGtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcAcaagtggggaggcggcccatgTgg cggagcagcAgagagcctacctggagggcaCgtgcgtggacgggctccgcagatacctggagaacgggaaggagac gctgcagcgcacgg;

A*0238:
(SEQ ID NO: 53)
gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcAcaagtgggagAcggcccatgagg cggagcagcAgagagcctacctggagggccggtgcgtggagtggctccgcagatacctggagaacgggaaggagac gctgcagcgcacgg;

A*0239:
(SEQ ID NO: 54)
gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccgtccagaggatgtTtggctgcga cgtggggtcggacgggcgcttcctccgcgggtaccaccagtacgcctacgacggcaaggattacatcgccctgaaa gaggacctgcgctcttggaccgcggcggacatggcGgctcagatcaccaagcAcaagtggggaggcggcccatgTgg cggagcagtTgagagCctacctggagggcaCgtgcgtggaGTggctccgcagatacctggagaacgggaaggagac gctgcagcgcacgg;

A*0240:
(SEQ ID NO: 55)
gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcAcaagtggggaggcggcccGtgTgg cggagcagttgagagcctacctggagggcaCgtgcgtggagTggctccgcagatacctggagaacgggaaggagac gctgcagcgcacgg;

A*0241:

(SEQ ID NO: 56)

gctctcactccatgaggtatttctacacCtccgtgtcccggcccggccgcggggagccccgcttcatcgcAgtggg ctacgtggacgacacgcagttcgtgcggttcgacagcgacgccgcgagccagaggatggagccgcgggcgccgtgg atagagcaggagggtccggagtattgggacgGggagacacggaaAgtgaaggcccactcacagactCaccgagtgg acctggggaccctgcgcggctactacaaccagagcgaggccggttctcacaccGtccagaGgatgtatggctgcga cgtggggtcggacTggcgcttcctccgcgggtaccagcagTacgcctacgacggcaaggattacatcgccctgaaA gaggacctgcgctcttggaccgcggcggacatggcagctcagaCcaccaagcacaagtgggaggcggcccatgTgg cggagcagtTgagagcctacctggagggcaCgtgcgtggagTggctccgcagatacctggagaacgggaaggagac gctgcagcgcacgg;

A*0242:

(SEQ ID NO: 57)

gctctcactccatgaggtatttcttcacatccgtgtcccggcccggccgcggggagccccgcttcatcTcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcacaagtgggaggcggcccatgtgg cggagcagttgagagcctacctggagggcacgtgcgtggagtggctccgcagatacctggagaacgggaaggagac gctgcagcgcacgg;

A*0244:

(SEQ ID NO: 58)

gctctcactccatgaggtatttctacacCtccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccGtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagatcaccaagcgcaagtgggaggcggcccatgTgg cggagcagcAgagagcctacctggagggcaCgtgcgtggagTggctccgcagatacctggagaacgggaaggagac gctgcagcgcacgg;

A*0245:

(SEQ ID NO: 59)

gctctcactccatgaggtatttcttcacatccgtgtcccggcccggccgcggggagccccgcttcatcgcAgtggg ctacgtggacgacacgcagttcgtgcggttcgacagcgacgccgcgagccagaggatggagccgcgggcgccgtgg atagagcaggagggtccggagtattgggaccaggagacacggaaAgtgaaggcccactcacagactCaccgagtgg acctggggaccctgcgcggctactacaaccagagcgaggccggttctcacaccGtccagaGgatgtatggctgcga cgtggggtcggacTggcgcttcctccgcgggtaccaCcagTacgcctacgacggcaaggattacatcgccctgaaA gaggacctgcgctcttggaccgcggcggacatggcagctcagaCcaccaagcacaagtgggaggcggcccatgTgg cggagcagtTgagagcctacctggagggcaCgtgcgtggagTggctccgcagatacctggagaacgggaaggagac gctgcagcgcacgg;

A*0246:
(SEQ ID NO: 60)
atggccgtcatggcgccccgaaccctcgtcctgctactctcgggggcTctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacgaggagacaGggaaAgtgaaggcccactcacagactCaccgagtggacc tggggaccctgcgcggctactacaaccagagcgaggccggttctcacaccGtccagaGgatgtatggctgcgacgt ggggtcggacTggcgcttcctccgcgggtaccaccagtacgcctacgacggcaaggattacatcgccctgaaagag gacctgcgctcttggaccgcggcggacatggcagctcagaccaccaagcacaagtgggaggcggcccatgTggcgg agcagtTgagagcctacctggagggcaCgtgcgtggagtggctccgcagatacctggagaacgggaaggagacgct gcagcgcacgg;

A*0247:
(SEQ ID NO: 61)
gctctcactccatgaggtatttcttcacatccgtgtcccggcccggccgcggggagccccgcttcatcgcagtggg ctacgtggacgacacgcagttcgtgcggttcgacagcgacgccgcgagccggaggatggagccgcgggcgccgtgg atagagcaggagggtccggagtattgggacggggagacacggaaagtgaaggcccactcacagaGtcaccgagtgg acctggggaccctgcgcggctactacaaccagagcgaggccggttctcacaccctccagaggatgtatggctgcga cgtggggtcggactggcgcttcctgcgcgggtaccaccagtacgcctacgacggcaaggattacatcgccctgaaa gaggacctgcgctcttggaccgcggcggacatggcagctcagaccaccaagcacaagtgggaggcggcccatgtgg cggagcagtggagagcctacctggagggcacgtgcgtggagtggctccgcagatacctggagaacgggaaggagac gctgcagcgcacgg;

A*0248:
(SEQ ID NO: 62)
gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcAcaagtgggaggcggcccatgTgg cggagcagtTgagagCctacctggagggcaCgtgcgtggaGTggctccgcagatacctggagaacgggaaggagac gctgcagcgcacgg;

A*0249:
(SEQ ID NO: 63)
gctctcactccatgaggtatttcttcacatccgtgtcccggcccggccgcggggagccccgcttcatcgcAgtggg ctacgtggacgacacgcagttcgtgcggttcgacagcgacgccgcgagccagaggatggagccgcgggcgccgtgg atagagcaggagggtccggagtattgggacgGggagacacggaaAgtgaaggcccactcacagactCaccgagtgg acctggggaccctgcgcggctactacaaccagagcgaggccggttctcacaccGtccagaGgatgtatggctgcga cgtggggtcggacTggcgcttcctccgcgggtaccaCcagTacgcctacgacggcaaggattacatcgccctgaaA gaggacctgcgctcttggaccgcggcggacatggcagctcagaCcaccaagcAcaagtgggaggcggcccatgTgg cggagcagcggagagcctacctggagggcaCgtgcgtggagTggctccgcagatacctggagaacgggaaggagac gctgcagcgcacgg;

A*0250:
(SEQ ID NO: 64)
gctcccactccatgaggtatttcttcacatccAtgtcccggcccggccgcggggagccccgcttcatcgccgtggg ctacgtggacgacacgcagttcgtgcggttcgacagcgacgccgcgagccagaggatggagccgcgggcgccgtgg -continued atagagcaggaggggccggagtattgggacggggagacacggaaAgtgaaggcccactcacagactCaccgagtgg acctggggaccctgcgcggctactacaaccagagcgaggccggttctcacaccatccagaggatgtatggctgcga cgtggggccggacgggcgcttcctccgcgggtaccaccagtacgcctacgacggcaaggattacatcgccctgaaa gaggacctgcgctcttggaccgcggcggacatggcagctcagaccaccaagcacaagtgggaggcggcccatgtgg cggagcagtggagagcctacctggagggcacgtgcgtggagtggctccgcagatacctggagaacgggaaggagac gctgcagcgcacgg;

A*0251:

(SEQ ID NO: 65)
gctctcactccatgaggtatttctacacCtccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcAcaagtgggaggcggcccGtgTgg cggagcagttgagagcctacctggagggcaCgtgcgtggagTggctccgcagatacctggagaacgggaaggagac gctgcagcgcacgg;

A*0252:

(SEQ ID NO: 66)
gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggacgggcgcttcctccgcgggtatgaAcagcacgcctacgacggcaaggattacatcgccctgaaa gaggacctgcgctcttggaccgcggcggacatggcagctcagaccaccaagcAcaagtgggaggcggcccatgTgg cggagcagtTgagagcctacctggagggcacgtgcgtggagtggctccgcagatacctggagaacgggaaggagac gctgcagcgcacgg;

A*0254:

(SEQ ID NO: 67)
gctctcactccatgaggtatttctacacCtccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccGtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcAcaagtgggaggcggcccatgTgg cggagcagcAgagagcctacctggagggcaCgtgcgtggacgggctccgcagatacctggagaacgggaaggagac gctgcagcgcacgg;

A*0255:

(SEQ ID NO: 68)
gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggaggggccggagtattgggaccggaaCacacggaatgtgaaggcccactcacagactCaccgagtgg acctggggaccctgcgcggctactacaaccagagcgaggccggttctcacaccGtccagaGgatgtatggctgcga cgtggggtcggacTggcgcttcctccgcgggtaccaCcagTacgcctacgacggcaaggattacatcgccctgaaA gaggacctgcgctcttggaccgcggcggacatggcagctcagaCcaccaagcacaagtgggaggcggcccatgTgg -continued cggagcagtTgagagcctacctggagggcaCgtgcgtggagTggctccgcagatacctggagaacgggaaggagac gctgcagcgcacgg;

A*0256:

(SEQ ID NO: 69)

atggccgtcatggcgccccgaaccctcgtcctgctactctcgggggcTctggccctgacccagacctgggcgggct ctcactccatgaggtatttcttcacatccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggaccaggagacacggaatgtgaaggcccaGtcacagactCaccgagtggacc tggggaccctgcgcggctactacaaccagagcgaggccggttctcacaccGtccagaGgatgtatggctgcgacgt ggggtcggacTggcgcttcctccgcgggtaccaccagtacgcctacgacggcaaggattacatcgccctgaaagag gacctgcgctcttggaccgcggcggacatggcagctcagaccaccaagcacaagtgggaggcggcccatgTggcgg agcagtTgagagcctacctggagggcaCgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtTtgcccaagcccctcaccctgagatggg;

A*0257:

(SEQ ID NO: 70)

atggccgtcatggcgccccgaaccctcgtcctgctactctcgggggcTctggccctgacccagacctgggcgggct ctcactccatgaggtatttctacacCtccgtgtcccggcccggccgcggggagccccgcttcatcgcagtgggcta cgtggacgacacgcagttcgtgcggttcgacagcgacgccgcgagccagaggatggagccgcgggcgccgtggata gagcaggagggtccggagtattgggacggggagacacggaaagtgaaggcccactcacagactcaccgagtggacc tggggaccctgcgcggctactacaaccagagcgaggccggttctcacaccCtccagatgatgtatggctgcgacgt ggggtcggacTggcgcttcctccgcgggtaccaccagtacgcctacgacggcaaggattacatcgccctgaaagag gacctgcgctcttggaccgcggcggacatggcagctcagaccaccaagcacaagtgggaggcggcccatgTggcgg agcagtTgagagcctacctggagggcaCgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtTtgcccaagcccctcaccctgagatgggag;

A*0258:

(SEQ ID NO: 71)

gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccCtccagaGgatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcAcaagtgggaggcggcccatgTgg cggagcagtTgagagCctacctggagggcaCgtgcgtggaGTggctccgcagatacctggagaacgggaaggagac gctgcagcgcacgg;

A*0259:

(SEQ ID NO: 72)

gctctcactccatgaggtatttcttcacatccgtgtcccggcccggccgcgAggagccccgcttcatcgcagtggg ctacgtggacgacacgcagttcgtgcggttcgacagcgacgccgcgagccagaggatggagccgcgggcgccgtgg -continued atagagcaggagggtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtacgcctacgacggcaaggattacatcgccctgaaa gaggacctgcgctcttggaccgcggcggacatggcagctcagaccaccaagcacaagtgggaggcggcccatgtgg cggagcagttgagagcctacctggagggcacgtgcgtggagtggctccgcagatacctggagaacgggaaggagac gctgcagcgcacggacgcccccaaaacgcatatgactcaccacgctgtctctgaccatgaagccaccctgaggtgc tgggccctgagcttctaccctgcggagatcacactgacctggcagcgggatggggaggaccagacccaggacacgg agctcgtggagaccaggcctgcaggggatggaaccttccagaagtgggcggctgtggtggtgccttctggacagga gcagagatacacctgccatgtgcagcatgagggtttgcccaagcccctcaccctgagatggg;

A*0260: (SEQ ID NO: 73)

gctctcactccatgaggtatttcttcacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagggtccggagtattgggacggggagacacggaaagtgaaggcccactcacagactcaccgagtgg acctggggaccctgcgcggctactacaaccagagcgaggccggttctcacaccgtccagaggatgtatggctgcga cgtggggtcggactggcgcttcctccgcgggtaccaccagtTcgcctacgacggcaaggattacatcgccctgaaa gaggacctgcgctcttggaccgcggcggacatggcagctcagaccaccaagcacaagtgggaggcggcccatgtgg cggagcagtTgagagcctacctggagggcacgtgcgtggagtggctccgcagatacctggagaacgggaaggagac gctgcagcgcacgg;

A*030101: (SEQ ID NO: 74)

atggccgtcatggcgccccgaaccctcctcctgctactctcgggggccctggccctgacccagacctgggcgggct cccactccatgaggtatttcttcacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccaggagacacggaatgtgaaggcccaGtcacagactgaccgagtgGacc tggggaccctgcgcggctactacaaccagagcgaggccggttctcacaccatccagataatgtatggctgcgacgt ggggtcggacgggcgcttcctccgcgggtaccggcaggacgcctacgacggcaaggattacatcgccctgaacgag gacctgcgctcttggaccgcggcggacatggcggctcagatcaccaagcgcaagtgggaggcggcccatgAggcgg agcagTTgagagcctacctggaTggcacgtgcgtggagtggctccgcagatacctggagaacgggaaggagacgct gcagcgcacggaccccccaagacacatatgacccaccaccccatctctgaccatgaggccaccctgaggtgctgg gccctgggcttctaccctgcggagatcacactgacctggcagcgggatggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatgggag;

A*030102: (SEQ ID NO: 75)

gctcccactccatgaggtatttcttcacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccaGtcacagactgaccgagtgG acctggggaccctgcgcggctactacaaccagagcgaggccggttctcacaccatccagataatgtatggctgcga cgtggggtcggacgggcgcttcctccgcgggtaccggcaggacgcctacgacggcaaggattacatcgccctgaac gaggacctgcgctcttggaccgcggcggacatggcggctcagatcaccaagcgcaagtgggaggcggcccatgAgg cggagcagcTgagagcctacctggaTggcacgtgcgtggagtggctccgcagatacctggagaacgggaaggagac gctgcagcgcacgg;

A*030103:

(SEQ ID NO: 76)

gctcccactccatgaggtatttcttcacatccgtgtcccggcccggccgcggggagccccgcttcatcgccgtggg
ctacgtggacgacacgcagttcgtgcggttcgacagcgacgccgcgagccagaggatggagccgcgggcgccgtgg
atagagcaggagggTccggagtattgggaccaggagacacggaatgtgaaggcccaGtcacagactgaccgagtgG
acctggggaccctgcgcggctactacaaccagagcgaggccggttctcacaccatccagataatgtatggctgcga
cgtggggtcggacgggcgcttcctccgcgggtaccggcaggacgcctacgacggcaaggattacatcgccctgaac
gaggacctgcgctcttggaccgcggcggacatggcggctcagatcaccaagcgcaagtgggaggcggcccatgAgg
cggagcagTTgagagcctacctggaTggcacgtgcgtggagtggctccgcagatacctggagaacgggaaggagac
gctgcagcgcacgg;

A*0302:

(SEQ ID NO: 77)

atggccgtcatggcgccccgaaccctcctcctgctactctcgggggccctggccctgacccagacctgggcgggct
cccactccatgaggtatttcttcacatccgtgtcccggcccggccgcggggagccccgcttcatcgccgtgggcta
cgtggacgacacgcagttcgtgcggttcgacagcgacgccgcgagccagaggatggagccgcgggcgccgtggata
gagcaggaggggccggagtattgggaccaggagacacggaatgtgaaggcccagtcacagactgaccgagtggacc
tggggaccctgcgcggctactacaaccagagcgaggccggttctcacaccatccagataatgtatggctgcgacgt
ggggtcggacgggcgcttcctccgcgggtaccggcaggacgcctacgacggcaaggattacatcgccctgaacgag
gacctgcgctcttggaccgcggcggacatggcggctcagatcaccaagcgcaagtgggaggcggcccatgtggcgg
agcagcAgagagcctacctggaTggcacgtgcgtggagtggctccgcagatacctggagaacgggaaggagacgct
gcagcgcacggacccccccaagacacatatgacccaccacccc atctctgaccatgaggccaccctgaggtgctgg
gccctgggcttctaccctgcggagatcacactgacctggcagcgggatggggaggaccagacccaggacacggagc
tcgtggagaccaggcctgcaggggatggaaccttccagaagtgggcggctgtggtggtgccttctggagaggagca
gagatacacctgccatgtgcagcatgagggtctgcccaagcccctcaccctgagatgggag;

A*0304:

(SEQ ID NO: 78)

atggccgtcatggcgccccgaaccctcctcctgctactctcgggggccctggccctgacccagacctgggcgggct
cccactccatgaggtatttcttcacatccgtgtcccggcccggccgcggggagccccgcttcatcgccgtgggcta
cgtggacgacacgcagttcgtgcggttcgacagcgacgccgcgagccagaggatggagccgcgggcgccgtggata
gagcaggaggggccggagtattgggaccaggagacacggaatgtgaaggcccagtcacagactgaccgagtggacc
tggggaccctgcgcggctactacaaccagagcgaggccggttctcacaccatccagataatgtatggctgcgacgt
ggggtcggacgggcgcttcctccgcgggtaccggcaggacgcctacgacggcaaggattacatcgccctgaacgag
gacctgcgctcttggaccgcggcggacatggcggctcagatcaccaagcgcaagtgggaggcggcccatgaggcgg
agcagttgagagcctacctggaTggcacgtgcgtggagtggctccgcagatacctggagaacCggaaggagacgct
gcagcgcacggacccccccaagacacatatgacccaccacccc atctctgaccatgaggccaccctgaggtgctgg
gccctgggcttctaccctgcggagatcacactgacctggcagcgggatggggaggaccagacccaggacacggagc
tcgtggagaccaggcctgcaggggatggaaccttccagaagtgggcggctgtggtggtgccttctggagaggagca
gagatacacctgccatgtgcagcatgagggtctgcccaagcccctcaccctgagatgggag;

A*0305:

(SEQ ID NO: 79)

tctcgggggccctggccctgacccagacctgggcgggctcccactccatgaggtatttcttcacatccgtgtcccg
gcccggccgcggggagccccgcttcatcgccgtgggctacgtggacgacacgcagttcgtgcggttcgacagcgac
gccgcgagccagaggatggagccgcgggcgccgtggatagagcaggaggggccggagtattgggaccaggagacac
ggaatgtgaaggcccaGtcacagactgaccgagtgGacctggggaccctgcgcggctactacaaccagagcgaggC -continued cggttctcacaccatccagataatgtatggctgcgacgtggggtcggacgggcgcttcctccgcgggtaccggcag gacgcctacgacggcaaggattacatcgccctgaacgaggacctgcgctcttggaccgcggcggacatggcGgctc agatcaccaagcgcaagtgggaggcggcccatgAggcggagcagTTgagagcctacctggagggcaCgtgcgtgga gtggctccgcagatacctggagaacgggaaggagacgctgcagcgcacggaccccccaagacacatatgacccac caccccatctctgaccatgaggccaccctgaggtgctgggccctgggcttctaccctgcggagatcacactgacct ggcagcgggatggggaggaccagacccaggacacggagctcgtggagaccaggcctgcagggatggaaccttcca gaagtgggcggctgtggtggtgccttctggagaggagcagagatacacctgccatgtgcagcatgagggtctgccc aagcccctcaccctgagatggg;

A*0306:
(SEQ ID NO: 80)
gctcccactccatgaggtatttcttcacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccagtcacagactgaccgagtgg acctggggaccctgcgcggctactacaaccagagcgaggccggttctcacaccatccagataatgtatggctgcga cgtggggtcggacgggcgcttcctccgcgggtaccggcaggacgcctacgacggcaaggattacatcgccctgaac gaggacctgcgctcttggaccgcggcggacatggcggctcagatcaccaagcgcaagtgggaggcggcccatgagg cggagcagttgagagcctacctggatgCcacgtgcgtggagtggctccgcagatacctggagaacgggaaggagac gctgcagcgcacgg;

A*0307:
(SEQ ID NO: 81)
gctcccactccatgaggtatttcttcacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccactcacagactgaccgagtgG acctggggaccctgcgcggctactacaaccagagcgaggccggttctcacaccatccagataatgtatggctgcga cgtggggtcggacgggcgcttcctccgcgggtaccggcaggacgcctacgacggcaaggattacatcgccctgaac gaggacctgcgctcttggaccgcggcggacatggcggctcagatcaccaagcgcaagtgggaggcggcccatgAgg cggagcagTTgagagcctacctggaTggcacgtgcgtggagtggctccgcagatacctggagaacgggaaggagac gctgcagcgcacgg;

A*0308:
(SEQ ID NO: 82)
gctcccactccatgaggtatttcttcacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccagtcacagactCaccgagtgG acctggggaccctgcgcggctactacaaccagagcgaggccggttctcacaccatccagataatgtatggctgcga cgtggggtcggacgggcgcttcctccgcgggtaccggcaggacgcctacgacggcaaggattacatcgccctgaac gaggacctgcgctcttggaccgcggcggacatggcggctcagatcaccaagcgcaagtgggaggcggcccatgAgg cggagcagTTgagagcctacctggaTggcacgtgcgtggagtggctccgcagatacctggagaacgggaaggagac gctgcagcgcacgg;

A*0309:
(SEQ ID NO: 83)
gctcccactccatgaggtatttcttcacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccagtcacagactCaccgagtgG acctggggaccctgcgcggctactacaaccagagcgaggccggttctcacaccatccagataatgtatggctgcga cgtggggtcggacgggcgcttcctccgcgggtaccggcaggacgcctacgacggcaaggattacatcgccctgaac -continued gaggacctgcgctcttggaccgcggcggacatggcggctcagatcaccaagcgcaagtgggaggcggcccatgAgg cggagcagTTgagagcctacctggaTggcacgtgcgtggagtggctccgcagatacctggagaacgggaaggagac gctgcagcgcacgg;

A*0310:
(SEQ ID NO: 84)
gctcccactccatgaggtatttcttcacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccagtcacagactgaccgagtgG acctggggaccctgcgcggctactacaaccagagcgaggccggttctcacaccatccagataatgtatggctgcga cgtggggTcggacgggcgcttcctccgcgggtaccggcaggacgcctacgacggcaaggattacatcgccctgaac gaggacctgcgctcttggaccgcggcggacatggcGgctcagatcaccaagcgcaagtgggaggcggcccatgTgg cggagcagcAgagagcctacctggagggcaCgtgcgtggaGTggctccgcagatacctggagaacgggaaggagac gctgcagcgcacgg;

A*110101:
(SEQ ID NO: 85)
atggccgtcatggcgccccgaaccctcctcctgctactctcgggggcccggccctgacccagacctgggcgggct cccactccatgaggtatttctacacCtccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccaggagacacggaatgtgaaggcccaGtcacagactgaccgagtgGacc tggggaccctgcgcggctactacaaccagagcgaggacggttctcacaccatccagataatgtatggctgcgacgt ggggccggacgggcgcttcctccgcgggtaccggcaggacgcctacgacggcaaggattacatcgccctgaacgag gacctgcgctcttggaccgcggcggacatggcagctcagatcaccaagcgcaagtgggaggcggcccatgcggcgg agcagcAgagagcctacctggagggccggtgcgtggaGTggctccgcagatacctggagaacgggaaggagacgct gcagcgcacggaccccccaagacacatatgacccaccaccccatctctgaccatgaggccaccctgaggtgctgg gccctgggcttctaccctgcggagatcacactgacctggcagcgggatggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatgggag;

A*110102:
(SEQ ID NO: 86)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccagtcacagactgaccgagtgg acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcAgacatggcagctcagatcaccaagcgcaagtgggaggcggcccatgcgg cggagcagcagagagcctacctggagggccggtgcgtggagtggctccgcagatacctggagaacgggaaggagac gctgcagcgcacggaccccccaagacacatatgacccaccaccccatctctgaccatgaggccaccctgaggtgc tgggccctgggcttctaccctgcggagatcacactgacctggcagcgggatggggaggaccagacccaggacacgg agctcgtggagaccaggcctgcaggggatggaaccttccagaagtgggcggctgtggtggtgccttctggagagga gcagagatacacctgccatgtgcagcatgagggtctgcccaagcccctcaccctgagatggg;

A*1102:
(SEQ ID NO: 87)
atggccgtcatggcgccccgaaccctcctcctgctactctcgggggcccggccctgacccagacctgggcgggct cccactccatgaggtatttctacacctccgtgtcccggcccggccgcgggAagccccgcttcatcgccgtgggcta -continued cgtggacgacacgcagttcgtgcggttcgacagcgacgccgcgagccagaggatggagccgcgggcgccgtggata gagcaggaggggccggagtattgggaccaggagacacggaatgtgaaggcccagtcacagactgaccgagtggacc tggggaccctgcgcggctactacaaccagagcgaggacggttctcacaccatccagataatgtatggctgcgacgt ggggccggacgggcgcttcctccgcgggtaccggcaggacgcctacgacggcaaggattacatcgccctgaacgag gacctgcgctcttggaccgcggcggacatggcagctcagatcaccaagcgcaagtgggaggcggcccatgcggcgg agcagcagagagcctacctggagggccggtgcgtggagtggctccgcagatacctggagaacgggaaggagacgct gcagcgcacggaccccccaagacacatatgacccaccaccccatctctgaccatgaggccaccctgaggtgctgg gccctgggcttctaccctgcggagatcacactgacctggcagcgggatggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatggg;

A*1103:

(SEQ ID NO: 88)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccagtcacagactgaccgagtgg acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggcccGtgAgg cggagcagcAgagagcctacctggagggccggtgcgtggagtggctccgcagatacctggagaacgggaaggagac gctgcagcgcacgg;

A*1104:

(SEQ ID NO: 89)
atggccgtcatggcgccccgaaccctcctcctgctactctcgggggccctggccctgacccagacctgggcgggct cccactccatgaggtatttctacacCtccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccaggagacacggaatgtgaaggcccaGtcacagactgaccgagtgGacc tggggaccctgcgcggctactacaaccagagcgaggacggttctcacaccatccagataatgtatggctgcgacgt ggggccggacgggcgcttcctccgcgggtaccggcaggacgcctacgacggcaaggattacatcgccctgaacgag gacctgcgctcttggaccgcggcggacatggcagctcagatcaccaagcgcaagtgggaggcggcccatgcggcgg agcagcAgagagcctacctggagggcaCgtgcgtggaGTggctccgcagatacctggagaacgggaaggagacgct gcagcgcacggaccccccaagacacatatgacccaccaccccatctctgaccatgaggccaccctgaggtgctgg gccctgggcttctaccctgcggagatcacactgacctggcagcgggatggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatgggag;

A*1105:

(SEQ ID NO: 90)
atggccgtcatggcgccccgaaccctcctcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccaggagacacggaatgtgaaggcccagtcacagactgaccgagtggacc tggggaccctgcgcggctactacaaccagagcgaggacggttctcacaccatccagataatgtatggctgcgacgt ggggccggacgggcgcttcctccgcgggtaccggcaggacgcctacgacggcaaggattacatcgccctgaacgag gacctgcgctcttggaccgcggcggacatggcagctcagatcaccGagcgcaagtgggaggcggcccatgcggcgg agcagcagagagcctacctggagggccggtgcgtggagtggctccgcagatacctggagaacgggaaggagacgct gcagcgcacggaccccccaagacacatatgacccaccaccccatctctgaccatgaggccaccctgaggtgctgg gccctgggcttctaccctgcggagatcacactgacctggcagcgggatggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatgggag;

A*1106:

(SEQ ID NO: 91)

gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccaGtcacagactCaccgagtgG acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggcccatgcgg cggagcagcAgagagcctacctggagggccggtgcgtggaGTggctccgcagatacctggagaacgggaaggagac gctgcagcgcacgg;

A*1107:

(SEQ ID NO: 92)

atggccgtcatggcgccccgaaccctcctcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccaggagacacggaatgtgaaggcccagtcacagactgaccgagtggacc tggggaccctgcgcggctactacaaccagagcgaggacggttctcacaccatccagataatgtatggctgcgacgt ggggccggacgggcgcttActccgcgggtaccggcaggacgcctacgacggcaaggattacatcgccctgaacgag gacctgcgctcttggaccgcggcggacatggcagctcagatcaccaagcgcaagtgggaggcggcccatgcggcgg agcagcagagagcctacctggagggccggtgcgtggagtggctccgcagatacctggagaacgggaaggagacgct gcagcgcacggaccccccaagacacatatgacccaccaccccatctctgaccatgaggccaccctgaggtgctgg gccctgggcttctaccctgcggagatcacactgacctggcagcgggatggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatgggag;

A*1108:

(SEQ ID NO: 93)

gctcccactccatgaggtatttctacacCtccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccaGtcacagactgaccgagtgG acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggcccatgAgg cggagcagcggagagcctacctggagggccggtgcgtggagtggctccgcagatacctggagaacgggaaggagac gctgcagcgcacgg;

A*1109:

(SEQ ID NO: 94)

gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccagtcacagactgaccgagtgg acctggggaccctgcgcggctactacaaccagagcgaggacggttctcacaccatccagataatgtatggctgcga -continued cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggcccatgcgg cggagcagcagagagcctacctgCagggccggtgcgtggagtggctccgcagatacctggagaacgggaaggagac gctgcagcgcacgg;

A*1110:

(SEQ ID NO: 95)
gctcccactccatgaggtatttctacacCtccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaaCacacggaatgtgaaggcccagtcacagactgaccgagtgG acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggcccatgcgg cggagcagcAgagagcctacctggagggccggtgcgtggagTggctccgcagatacctggagaacgggaaggagac gctgcagcgcacgg;

A*1111:

(SEQ ID NO: 96)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccTgcagacacggaatgtgaaggcccagtcacagactgaccgagtgG acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggcccatgcgg cggagcagcAgagagcctacctggagggccggtgcgtggagTggctccgcagatacctggagaacgggaaggagac gctgcagcgcacgg;

A*1112:

(SEQ ID NO: 97)
ggctcccactccatgaggtatttctacacCtccgtgtcccggcccggccgcggggagccccgcttcatcgccgtgg gctacgtggacgacacgcagttcgtgcggttcgacagcgacgccgcgagccagaggatggagccgcgggcgccgtg gatagagcaggaggggccggagtattgggaccaggagacacggaatgtgaaggcccaGtcacagactgaccgagtg GacctggggaccctgcgcggctactacaaccagagcgaggCcggttctcacaccatccagataatgtatggctgcg acgtggggccggacgggcgcttcctccgcgggtaccggcaggacgcctacgacggcaaggattacatcgccctgaa cgaggacctgcgctcttggaccgcggcggacatggcagctcagatcaccaagcgcaagtgggaggcggcccatgcg gcggagcagcAgagagcctacctggagggccggtgcgtggaGTggctccgcagatacctggagaacgggaaggaga cgctgcagcgcacg;

A*1113:

(SEQ ID NO: 98)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccagtcacagactgaccgagtgg acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaGgcgcaagtgggaggcggcccatgcgg cggagcagcagagagcctacctggagggccggtgcgtggagtggctccgcagatacctggagaacgggaaggagac gctgcagcgcacgg;

-continued

A*1114:
(SEQ ID NO: 99)
ccctggccctgacccagacctgggcgggctcccactccatgaggtatttctacacctccgtgtcccggcccggccg cgggAagccccgcttcatcgccgtgggctacgtggacgacacgcagttcgtgcggttcgacagcgacgccgcgagc cagaggatggagccgcgggcgccgtggatagagcaggaggggccggagtattgggaccaggagacacggaatgtga aggcccagtcacagactgaccgagtggacctggggaccctgcgcggctactacaaccagagcgaggacggttctca caccatccagataatgtatggctgcgacgtggggccggacgggcgcttcctccgcgggtaccggcaggacgcctac gacggcaaggattacatcgccctgaacgaggacctgcgctcttggaccgcggcggacatggcagctcagatcacca agcgcaagtgggaggcggcccgtcGggcggagcagcagagagcctacctggagggccggtgcgtggagtggctccg cagatacctggagaacgggaaggagacgctgcagcgcacgg;

A*2301:
(SEQ ID NO: 100)
atggccgtcatggcgccccgaaccctcgtcctgctactctcgggggccctggccctgacccagacctgggcaggct cccactccatgaggtatttctccacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggacgaggagacagggaaaGtgaaggcccactcacagactgaccgagagaacc tgcggatcgcgctccgctactacaaccagagcgaggccggttctcacaccctccagatgatgtttggctgcgacgt ggggtcggacgggcgcttcctccgcgggtaccaccagtacgcctacgacggcaaggattacatcgccctgaaagag gacctgcgctcttggaccgcggcggacatggcggctcagatcacccagcgcaagtgggaggcggcccgtgtggcgg agcagtTgagagCctacctggagggcacgtgcgtggacgggctccgcagatacctggagaacgggaaggagacgct gcagcgcacggaccccccaagacacatatgacccaccacccatctctgaccatgaggccactctgagatgctgg gcctgggcttctaccctgcggagatcacactgacctggcagcgggatgggggaggaccagacccaggacacggagc ttgtggagaccaggcctgcaggggatggaaccttccagaagtgggcAgctgtggtggtaccttctggagaggagca gagatacacctgccatgtgcagcatgagggtctgcccaagcccctcaccctgagatgggag;

A*2302:
(SEQ ID NO: 101)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaA gaggacctgcgctcttggaccgcggcggacatggcggctcagatcacccagcgcaagtgggaggcggcccGtgTgg cggagcagTggagagCctacctggagggcaCgtgcgtggacgggctccgcagatacctggagaacgggaaggagac gctgcagcgcacgg;

A*2303:
(SEQ ID NO: 102)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacagggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagTacgcctacgacggcaaggattacatcgccTtgaac gaggacctgcgctcttggaccgcggcggacatggcggctcagatcacccagcgcaagtgggaggcggcccGtgtgg cggagcagtTgagagcctacctggagggcacgtgcgtggacgggctccgcagatacctggagaacgggaaggagac gctgcagcgcacgg;

A*2304:
(SEQ ID NO: 103)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaA gaggacctgcgctcttggaccgcggcggacatggcggctcagatcacccagcgcaagtgggaggcggcccGtgTgg cggagcagtTgagagCctacctggagggcaCgtgcgtggaGTggctccgcagatacctggagaacgggaaggagac gctgcagcgcacgg;

A*2305:
(SEQ ID NO: 104)
gctcccactccatgaggtGtttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacagggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaa gaggacctgcgctcttggaccgcggcggacatggcggctcagatcacccagcgcaagtgggaggcggcccgtgtgg cggagcagtTgagagcctacctggagggcacgtgcgtggacgggctccgcagatacctggagaacgggaaggagac gctgcagcgcacgg;

A*2306:
(SEQ ID NO: 105)
atggccgtcatggcgccccgaaccctcgtcctgctactctcgggggccctggccctgacccagacctgggcaggct cccactccatgaggtatttctccacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggacgaggagacagggaaagtgaaggcccactcacagactgaccgagagaacc tgcggatcgcgctccgctactacaacGagagcgaggccggttctcacaccctccagatgatgtttggctgcgacgt ggggtcggacgggcgcttcctccgcgggtaccaccagtacgcctacgacggcaaggattacatcgccctgaaagag gacctgcgctcttggaccgcggcggacatggcggctcagatcacccagcgcaagtgggaggcggcccgtgtggcgg agcagttgagagcctacctggagggcacgtgcgtggacgggctccgcagatacctggagaacgggaaggagacgct gcagcgcacggaccccccccaagacacatatgacccaccacccatctctgaccatgaggccactctgagatgctgg gccctgggcttctaccctgcggagatcacactgacctggcagcgggatggggaggaccagacccaggacacggagc ttgtggagaccaggcctgcaggggatggaaccttccagaagtgggcagctgtggtggtaccttctggagaggagca gagatacacctgccatgtgcagcatgagggtctgcccaagcccctcaccctgagatgggag;

A*2309:
(SEQ ID NO: 106)
atggccgtcatggcgccccgaaccctcgtcctgctactctcgggggccctggccctgacccagacctgggcaggct cccactccatgaggtatttctccacatccgtgtcccggcccggccgcggggagccccgcttcatccgcgtgggcta cgtggacgacacgcagttcgtgcggttcgacagcgacgccgcgagccagaggatggagccgcgggcgccgtggata gagcaggaggggccggagtattgggaccaggagacacggaatatgaaggcccactcacagactgaccgagagaacc tgcggatcgcgctccgctactacaaccagagcgaggccggttctcacaccctccagatgatgtttggctgcgacgt ggggtcggacgggcgcttcctccgcgggtaccaccagtacgcctacgacggcaaggattacatcgccctgaaagag gacctgcgctcttggaccgcggcggacatggcggctcagatcacccagcgcaagtgggaggcggcccgtgtggcgg agcagtTgagagCctacctggagggcacgtgcgtggacgggctccgcagatacctggagaacgggaaggagacgct gcagcgcacggaccccccccaagacacatatgacccaccaccccatctctgaccatgaggccactctgagatgctgg gccctgggcttctaccctgcggagatcacactgacctggcagcgggatggggaggaccagacccaggacacggagc ttgtggagaccaggcctgcaggggatggaaccttccagaagtgggcAgctgtggtggtaccttctggagaggagca gagatacacctgccatgtgcagcatgagggtctgcccaagcccctcaccctgagatgggag;

A*240201:

(SEQ ID NO: 107)

atggccgtcatggcgccccgaaccctcgtcctgctactctcgggggccctggccctgacccagacctgggcaggct cccactccatgaggtatttctccacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggacgaggagacaGggaaagtgaaggcccactcacagactgaccgagagaacc tgcggatcgcgctcCgctactacaaccagagcgaggccggttctcacaccctccagatgatgtttggctgcgacgt ggggtcggacgggcgcttcctccgcgggtaccaccagtacgcctacgacggcaaggattacatcgccctgaaagag gacctgcgctcttggaccgcggcggacatggcggctcagatcaccaagcgcaagtgggaggcggcccatgtggcgg agcagcAgagagCctacctggagggcacgtgcgtggacgggctccgcagatacctggagaacgggaaggagacgct gcagcgcacggacccccccaagacacatatgacccaccacccatctctgaccatgaggccactctgagatgctgg gccctgggcttctaccctgcggagatcacactgacctggcagcgggatggggaggaccagacccaggacacggagc ttgtggagaccaggcctgcaggggatggaaccttccagaagtgggcAgctgtggtggtaccttctggagaggagca gagatacacctgccatgtgcagcatgagggtctgcccaagcccctcaccctgagatgggag;

A*240202:

(SEQ ID NO: 108)

gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctcCgctactacaaccagagcgaggCcggttctcacaccctccagatgatgtTtggctgcga cgtggggTcggacgggcgcttcctccgcgggtaccaccagTacgcctacgacggcaaggattacatcgccctgaaA gaggacctgcgctcttggaccgcggcggacatggcagctcagatcaccaagcgcaagtgggaggcggcccatgtgg cggagcagcAgagagCctacctggagggcaCgtgcgtggacgggctccgcagatacctggagaacgggaaggagac gctgcagcgcacgg;

A*240203:

(SEQ ID NO: 109)

atggccgtcatggcgccccgaaccctcgtcctgctactctcgggggccctggccctgacccagacctgggcaggct cccactccatgaggtatttctccacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggacgaggagacagggaaagtgaaggcccactcacagactgaccgagagaacc tgcggatcgcgctccgctactacaaccagagcgaggccggttctcacaccctccagatgatgtttggctgcgacgt ggggtcggacgggcgcttcctccgcgggtaccaccagtacgcctacgacggcaaggattacatcgccctgaaagag gacctgcgctcttggaccgcggcggacatggcggctcagatcaccaagcgcaagtgggaggcggcccatgtggcgg agcagcagagagcctacctggagggcacgtgcgtggacgggctccgcagatacctggagaacgggaaggagacgct gcagcgcacggacccccccaagacacatatgacccaccacccatctctgaccatgaggccactctgagatgctgg gccctgggcttctaccctgcAgagatcacactgacctggcagcgggatggggaggaccagacccaggacacggagc ttgtggagaccaggcctgcaggggatggaaccttccagaagtgggcagctgtggtggtaccttctggagaggagca gagatacacctgccatgtgcagcatgagggtctgcccaagcccctcaccctgagatgggag;

A*240204:

(SEQ ID NO: 110)
gctcccactccatgaggtatttctccacatccgtgtcccggcccggccgcggggagccccgcttcatcgccgtggg
ctacgtggacgacacgcagttcgtgcggttcgacagcgacgccgcgagccagaggatggagccgcgggcgccgtgg
atagagcaggaggggccggagtattgggacgaggagacagggaaagtgaaggcccactcacagactgaccgagaga
acctgcggatcgcgctccgctactacaaccagagcgaggccggttctcacaccctccagatgatgtttggctgcga
cgtggggtcggacgggcgcttcctccgcgggtaccaccagtaTgcctacgacggcaaggattacatcgccctgaaa
gaggacctgcgctcttggaccgcggcggacatggcggctcagatcaccaagcgcaagtgggaggcggcccatgtgg
cggagcagcagagagcctacctggagggcacgtgcgtggacgggctccgcagatacctggagaacgggaaggagac
gctgcagcgcacgg;

A*240301:

(SEQ ID NO: 111)
atggccgtcatggcgccccgaaccctcgtcctgctactctcgggggccctggccctgacccagacctgggcaggct
cccactccatgaggtatttctccacatccgtgtcccggcccggccgcggggagccccgcttcatcgccgtgggcta
cgtggacgacacgcagttcgtgcggttcgacagcgacgccgcgagccagaggatggagccgcgggcgccgtggata
gagcaggaggggccggagtattgggacgaggagacagggaaagtgaaggcccactcacagactgaccgagagaacc
tgcggatcgcgctccgctactacaaccagagcgaggccggttctcacaccctccagatgatgtttggctgcgacgt
ggggtcggacgggcgcttcctccgcgggtaccaccagtacgcctacgacggcaaggattacatcgccctgaaagag
gacctgcgctcttggaccgcggcggacatggcggctcagatcaccaagcgcaagtgggaggcggcccatgtggcgg
agcagcagagagCctacctggagggcacgtgcgtggagTggctccgcagatacctggagaacgggaaggagacgct
gcagcgcacggaccccccaagacacatatgacccaccacccatctctgaccatgaggccactctgagatgctgg
gcctgggcttctaccctgcggagatcacactgacctggcagcgggatggggaggaccagacccaggacacggagc
ttgtggagaccaggcctgcaggggatggaaccttccagaagtgggcAgctgtggtggtaccttctggagaggagca
gagatacacctgccatgtgcagcatgagggtctgcccaagcccctcaccctgagatgggag;

A*240302:

(SEQ ID NO: 112)
gctcccactccatgaggtatttctccacatccgtgtcccggcccggccgcggggagccccgcttcatcgccgtggg
ctacgtggacgacacgcagttcgtgcggttcgacagcgacgccgcgagccagaggatggagccgcgggcgccgtgg
atagagcaggaggggccggagtattgggacgaggagacaGggaaagtgaaggcccactcacagactgaccgagaga
acctgcggatcgcgctccgctactacaaccagagcgaggccggttctcacaccctccagatgatgtttggctgcga
cgtggggtcggacgggcgcttcctccgcgggtaccaccagtacgcctacgacggcaaggattacatcgccctgaaa
gaggacctgcgctcttggaccgcggcggacatggcggctcagatcaccaagcgcaagtgggaggcggcccatgtgg
cggagcagcAgagagCctacctggagggcaCgtgcgtggaGTggctccgcagatacctggagaacgggaaggagac
gctgcagcgcactg;

A*2404:

(SEQ ID NO: 113)
atggccgtcatggcgccccgaaccctcgtcctgctactctcgggggccctggccctgacccagacctgggcaggct
cccactccatgaggtatttctccacatccgtgtcccggcccggccgcggggagccccgcttcatcgccgtgggcta
cgtggacgacacgcagttcgtgcggttcgacagcgacgccgcgagccagaggatggagccgcgggcgccgtggata
gagcaggaggggccggagtattgggacgaggagacaGggaaagtgaaggcccactcacagactgaccgagcgaacc
tgggaccctgcgcggctactacaaccagagcgaggccggttctcacaccctccagatgatgtttggctgcgacgt
ggggtcggacgggcgcttcctccgcgggtaccaccagtacgcctacgacggcaaggattacatcgccctgaaagag
gacctgcgctcttggaccgcggcggacatggcggctcagatcaccaagcgcaagtgggaggcggcccatgtggcgg
agcagcAgagagCctacctggagggcacgtgcgtggacgggctccgcagatacctggagaacgggaaggagacgct

```
gcagcgcacggaccccccaagacacatatgacccaccaccccatctctgaccatgaggccactctgagatgctgg gccctgggcttctaccctgcggagatcacactgacctggcagcgggatggggaggaccagacccaggacacggagc ttgtggagaccaggcctgcaggggatggaaccttccagaagtgggcAgctgtggtggtaccttctggagaggagca gagatacacctgccatgtgcagcatgagggtctgcccaagcccctcaccctgagatgggag;
```

A*2405: (SEQ ID NO: 114)

```
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaa gaggacctgcgctcttggaccgcggcggacatggcggctcagatcaccCagcgcaagtgggaggcggcccatgtgg cggagcagcAgagagCctacctggagggcaCgtgcgtggacgggctccgcagatacctggagaacgggaaggagac gctgcagcgcacgg;
```

A*2406: (SEQ ID NO: 115)

```
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaA gaggacctgcgctcttggaccgcggcggacatggcGgctcagatcaccaagcgcaagtgggaggcggcccatgTgg cggagcagTggagagCctacctggagggcaCgtgcgtggacgggctccgcagatacctggagaacgggaaggagac gctgcagcgcacgg;
```

A*2407: (SEQ ID NO: 116)

```
atggccgtcatggcgccccgaaccctcgtcctgctactctcgggggccctggccctgacccagacctgggcaggct cccactccatgaggtatttctccacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggacgaggagacagggaaagtgaaggcccaGtcacagactgaccgagagaacc tgcggatcgcgctcCgctactacaaccagagcgaggccggttctcacaccctccagatgatgtttggctgcgacgt ggggtcggacgggcgcttcctccgcgggtaccaccagtacgcctacgacggcaaggattacatcgccctgaaagag gacctgcgctcttggaccgcggcggacatggcggctcagatcaccaagcgcaagtgggaggcggcccatgtggcgg agcagcAgagagCctacctggagggcacgtgcgtggacgggctccgcagatacctggagaacgggaaggagacgct gcagcgcacggaccccccaagacacatatgacccaccaccccatctctgaccatgaggccactctgagatgctgg gccctgggcttctaccctgcggagatcacactgacctggcagcgggatggggaggaccagacccaggacacggagc ttgtggagaccaggcctgcaggggatggaaccttccagaagtgggcAgctgtggtggtaccttctggagaggagca gagatacacctgccatgtgcagcatgagggtctgcccaagcccctcaccctgagatgggag;
```

A*2408: (SEQ ID NO: 117)

```
atggccgtcatggcgccccgaaccctcgtcctgctactctcgggggccctggccctgacccagacctgggcaggct cccaAtccatgaggtatttctccacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggacggggagacacggaaagtgaaggcccactcacagactgaccgagagaacc tgcggatcgcgctccgctactacaaccagagcgaggccggttctcacaccctccagatgatgtttggctgcgacgt
```

-continued ggggtcggacgggcgcttcctccgcgggtaccaccagtacgcctacgacggcaaggattacatcgccctgaaagag gacctgcgctcttggaccgcggcggacatggcggctcagatcaccaagcgcaagtgggaggcggcccatgtggcgg agcagcagagagcctacctggagggcacgtgcgtggacgggctccgcagatacctggagaacgggaaggagacgct gcagcgcacggaccccccaagacacatatgacccaccacccatctctgaccatgaggccactctgagatgctgg gccctgggcttctaccctgcggagatcacactgacctggcagcgggatggggaggaccagacccaggacacggagc ttgtggagaccaggcctgcaggggatggaaccttccagaagtgggcagctgtggtggtAccttctggagaggagca gagatacacctgccatgtgcagcatgagggtctgcccaagcccctcaccctgagatgggag;

A*2410:

(SEQ ID NO: 118)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaa gaggacctgcgctcttggaccgcggcggacatggcggctcagatcaccaagcgcaagtgggaggcggcccatgtgg cggagcagcAgagagCctacctggagggccggtgcgtggaGTggctccgcagatacctggagaacgggaaggagac gctgcagcgcacgg;

A*2413:

(SEQ ID NO: 119)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaaA gaggacctgcgctcttggaccgcggcggacatggcGgctcagatcaccaagcgcaagtgggaggcggcccatgTgg cggagcagtTgagagCctacctggagggcaCgtgcgtggacgggctccgcagatacctggagaacgggaaggagac gctgcagcgcacgg;

A*2414:

(SEQ ID NO: 120)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctccgctactacaaccagagcgaggccggttctcacaccgtccagaggatgtatggctgcga cgtggggtcggacTggcgcttcctccgcgggtaccaccagTacgcctacgacggcaaggattacatcgccctgaaaA gaggacctgcgctcttggaccgcggcggacatggcGgctcagatcaccaagcgcaagtgggaggcggcccatgtgg cggagcagcAgagagCctacctggagggcaCgtgcgtggacgggctccgcagatacctggagaacgggaaggagac gctgcagcgcacgg;

A*2415:

(SEQ ID NO: 121)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctcCgctactacaaccagagcgaggCcggttctcacaccCtccagatgatgtatggctgcga cgtggggccggacgggcgcttcctccgcgggtaccaccagTacgcctacgacggcaaggattacatcgccctgaaaA -continued gaggacctgcgctcttggaccgcggcggacatggcGgctcagatcaccaagcgcaagtgggaggcggcccatgtgg cggagcagcAgagagCctacctggagggcaCgtgcgtggacgggctccgcagatacctggagaacgggaaggagac gctgcagcgcacgg;

A*2417:
(SEQ ID NO: 122)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctcCgctactacaaccagagcgaggCcggttctcacaccctccagatgatgtTtggctgcga cgtggggTcggacgggcgcttcctccgcgggtaccggcaggacgcctacgacggcaaggattacatcgccctgaaA gaggacctgcgctcttggaccgcggcggacatggcGgctcagatcaccaagcgcaagtgggaggcggcccatgtgg cggagcagcAgagagCctacctggagggcaCgtgcgtggacgggctccgcagatacctggagaacgggaaggagac gctgcagcgcacgg;

A*2418:
(SEQ ID NO: 123)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacagggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaA gaggacctgcgctcttggaccgcggcggacatggcggctcagatcaccaagcgcaagtgggaggcggcccatgAgg cggagcagTTgagagcctacctggaTggcacgtgcgtggagtggctccgcagatacctggagaacgggaaggagac gctgcagcgcacgg;

A*2419:
(SEQ ID NO: 124)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccaGtcacagactgaccgagtgG acctggggaccctgcgcggctactacaaccagagcgaggacggttctcacaccctccagatgatgtTtggctgcga cgtggggTcggacgggcgcttcctccgcgggtaccaccagTacgcctacgacggcaaggattacatcgccctgaaA gaggacctgcgctcttggaccgcggcggacatggcGgctcagatcaccaagcgcaagtgggaggcggcccatgtgg cggagcagcAgagagCctacctggagggcaCgtgcgtggacgggctccgcagatacctggagaacgggaaggagac gctgcagcgcacgg;

A*2420:
(SEQ ID NO: 125)
gctcccaatccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctcCgctactacaaccagagcgaggCcggttctcacaccctccagatgatgtTtggctgcga cgtggggTcggacgggcgcttcctccgcgggtaccaccagTacgcctacgacggcaaggattacatcgccctgaaA gaggacctgcgctcttggaccgcggcggacatggcGgctcagatcaccaagcgcaagtgggaggcggcccatgtgg cggagcagcAgagagCctacctggagggcaCgtgcgtggacgggctccgcagatacctggagaacgggaaggagac gctgcagcgcacgg;

A*2421:

(SEQ ID NO: 126)

gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctcCgctactacaaccagagcgaggCcggttctcacaccctccagatgatgtTtggctgcga cgtggggTcggacgggcgcttcctccgcgggtaccaccagTacgcctacgacggcaaggattacatcgccctgaac gaggacctgcgctcttggaccgcggcggacatggcGgctcagatcaccaagcgcaagtgggaggcggcccatgtgg cggagcagcAgagagCctacctggagggcaCgtgcgtggacgggctccgcagatacctggagaacgggaaggagac gctgcagcgcacgg;

A*2422:

(SEQ ID NO: 127)

atggccgtcatggcgccccgaaccctcgtcctgctactctcgggggccctggccctgacccagacctgggcaggct cccactccatgaggtatttctccacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggacgaggagacagggaaagtgaaggcccactcacagactgaccgagagaacc tgcggatcgcgctccgctactacaaccagagcgaggccggttctcacaccctccagatgatgtttggctgcgacgt ggggtcggacgggcgcttcctccgcgggtaccaccagtacgcctacgacggcaaggattacatcgccctgaaagag gacctgcgctcttggaccgcggcggacatggcggctcagatcaccaagcgcaagtgggaggcggcccatgtggcgg agcagTggagagtctacctggagggcacgtgcgtggagTggctccgcagatacctggagaacgggaaggagacgct gcagcgcacggaccccccccaagacacatatgacccaccacccatctctgaccatgaggccactctgagatgctgg gccctgggcttctaccctgcggagatcacactgacctggcagcgggatggggaggaccagacccaggacacggagc ttgtggagaccaggcctgcaggggatggaaccttccagaagtgggcAgctgtggtggtaccttctggagaggagca gagatacacctgccatgtgcagcatgagggtctgcccaagcccctcaccctgagatgggag;

A*2423:

(SEQ ID NO: 128)

gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaa gaggacctgcgctcttggaccgcggcggacatggcggctcagatcaccaagcgcaagtgggaggcggcccatgtgg cggagcagcAgagagCctacctggagggcaCgtgcgtggacTggctccgcagatacctggagaacgggaaggagac gctgcagcgcacgg;

A*2424:

(SEQ ID NO: 129)

gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccaGtcacagactgaccgagaga acctgcggatcgcgctccgctactacaaccagagcgaggccggttctcacaccctccagatgatgtTtggctgcga cgtggggtcggacgggcgcttcctccgcgggtaccaccagtacgcctacgacggcaaggattacatcgccctgaaA gaggacctgcgctcttggaccgcggcggacatggcggctcagatcacccagcgcaagtgggaggcggcccGtgTgg cggagcagtTgagagCctacctggagggcaCgtgcgtggacgggctccgcagatacctggagaacgggaaggagac gctgcagcgcacgg;

A*2425:
(SEQ ID NO: 130)
gctcccactccatgaggtGtttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacagggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaa gaggacctgcgctcttggaccgcggcggacatggcggctcagatcaccaagcgcaagtgggaggcggcccatgtgg cggagcagcAgagagcctacctggagggcacgtgcgtggacgggctccgcagatacctggagaacgggaaggagac gctgcagcgcacgg;

A*2426:
(SEQ ID NO: 131)
aaccctcctcctgctactctcggggccctggccctgacccagacctgggcaggctcccactccatgaggtatttc tccacatccgtgtcccggcccggccgcggggagccccgcttcatcgccgtgggctacgtggacgacacgcagttcg tgcggttcgacagcgacgccgcgagccagaggatggagccgcgggcgccgtggatagagcaggaggggccggagta ttgggacgaggagacagggaaagtgaaggcccactcacagactgaccgagagaacctgcggatcgcgctccgctac tacaaccagagcgaggccggttctcacaccctccagatgatgtttggctgcgacgtggggtcggacgggcgcttcc tccAcgggtaccaccagtacgcctacgacggcaaggattacatcgccctgaaagaggacctgcgctcttggaccgc ggcggacatggcggctcagatcaccaagcgcaagtgggaggcggcccatgtggcggagcagcagagagcctacctg gagggcacgtgcgtggacgggctccgcagatacctggagaacgggaaggagacgctgcagcgcacgg;

A*2427:
(SEQ ID NO: 132)
atggccgtcatggcgccccgaaccctcgtcctgctactctcggggccctggccctgacccagacctgggcaggct cccactccatgaggtatttctccacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggacgaggagacagggaaagtgaaggcccactcacagactgaccgagagaacc tgcggatcgcgctccgctactacaaccagagcgaggccggttctcacaccctccagatgatgtttggctgcgacgt ggggtcggacgggcgcttcctccgcgggtaccaccagtacgcctacgacggcaaggattacatcgccctgaaagag gacctgcgctcttggaccgcggcggacaGggcggctcagatcaccaagcgcaagtgggaggcggcccatgtggcgg agcagcagagagcctacctggagggcacgtgcgtggacgggctccgcagatacctggagaacgggaaggagacgct gcagcgcacgg;

A*2428:
(SEQ ID NO: 133)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactcaccgagtgG acctggggaccctgcgcggctactacaaccagagcgaggCcggttctcacaccctccagatgatgtTtggctgcga cgtggggTcggacgggcgcttcctccgcgggtaccaccagTacgcctacgacggcaaggattacatcgccctgaaA gaggacctgcgctcttggaccgcggcggacatggcGgctcagatcaccaagcgcaagtgggaggcggcccatgtgg cggagcagcAgagagCctacctggagggcaCgtgcgtggacgggctccgcagatacctggagaacgggaaggagac gctgcagcgcacgg;

A*2429:
(SEQ ID NO: 134)
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacacggaaagtgaaggcccactcacagactgaccgagaga

```
acctgcggatcgcgctcCgctactacaaccagagcgaggCcggttctcacaccctccagatgatgtTtggctgcga cgtggggtcggacgggcgcttcctccgcgggtaccaccagTacgcctacgacggcaaggattacatcgccctgaaA gaggacctgcgctcttggaccgcggcggacatggcGgctcagatcaccaagcgcaagtgggaggcggcccatgtgg cggagcagcAgagagCctacctggagggcaCgtgcgtggacgggctccgcagatacctggagaacgggaaggagac gctgcagcgcacgg;
```

A*2430:

(SEQ ID NO: 135)
```
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactCaccgagaga acctgcggatcgcgctcCgctactacaaccagagcgaggCcggttctcacaccctccagatgatgtTtggctgcga cgtggggTcggacgggcgcttcctccgcgggtaccaccagTacgcctacgacggcaaggattacatcgccctgaaA gaggacctgcgctcttggaccgcggcggacatggcGgctcagatcaccaagcgcaagtgggaggcggcccatgtgg cggagcagcAgagagCctacctggagggcaCgtgcgtggacgggctccgcagatacctggagaacgggaaggagac gctgcagcgcacgg;
```

A*2431:

(SEQ ID NO: 136)
```
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgagCagacagggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaa gaggacctgcgctcttggaccgcggcggacatggcggctcagatcaccaagcgcaagtgggaggcggcccatgTgg cggagcagcAgagagcctacctggagggcaCgtgcgtggacgggctccgcagatacctggagaacgggaaggagac gctgcagcgcacgg;
```

A*2432:

(SEQ ID NO: 137)
```
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacagggaaagtgaaggcccactcacagactgaccgagaga Gcctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaA gaggacctgcgctcttggaccgcggcggacatggcggctcagatcaccaagcgcaagtgggaggcggcccatgtgg cggagcagcAgagagcctacctggagggcaCgtgcgtggacgggctccgcagatacctggagaacgggaaggagac gctgcagcgcacgg;
```

A*2433:

(SEQ ID NO: 138)
```
gctcccactccatgaggtatttctccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacagggaaagtgaaggcccactcacagactgaccgagaga acctgcggatcgcgctccgctactacaaccagagcgaggccggttctcacaccctccagatgatgtttggctgcga cgtggggtcggacgggcgcttcctccgcgggtaccaccagtacgcctacgacggcaaggattacatcgccctgaaa gaggacctgcgctcttggaccgcggcggacatggcGgctcagatcaccaagcgcaagtgggaggcggcccatgTgg cggagcagcAgagagcctacctggagggcaCgtgcgtggagtggctccgcagatacctggagaacgggaaggagac
```

-continued gctgcagcgcacggacgcccccaaaacgcatatgactcaccacgctgtctctgaccatgaagccaccctgaggtgc
tgggccctgagcttctaccctgcggagatcacactgacctggcagcgggatggggaggaccagacccaggacacgg
agctcgtggagaccaggcctgcaggggatggaacttccagaagtgggcggctgtggtggtgccttctggacagga
gcagagatacacctgccatgtgcagcatgagggtTtgcccaagcccctcaccctgagatggg;

A*2434:
(SEQ ID NO: 139)
gctcccactccatgaggtatttctccacatccgtgtcccggcccggccgcggggagccccgcttcatcgccgtggg
ctacgtggacgacacgcagttcgtgcggttcgacagcgacgccgcgagccagaggatggagccgcgggcgccgtgg
atagagcaggaggggccggagtattgggacgaggagacagggaaagtgaaggcccactcacagaTtgaccgagaga
acctgcggatcgcgctccgctactacaaccagagcgaggccggttctcacaccctccagatgatgtttggctgcga
cgtggggtcggacgggcgcttcctccgcgggtaccaccagtacgcctacgacggcaaggattacatcgccctgaaa
gaggacctgcgctcttggaccgcggcggacatggcggctcagatcaccaagcgcaagtgggaggcggcccatgtgg
cggagcagcAgagagcctacctggagggcacgtgcgtggacgggctccgcagatacctggagaacgggaaggagac
gctgcagcgcacgg;

A*2435:
(SEQ ID NO: 140)
gctcccactccatgaggtatttctccacatccgtgtcccggcccggccgcggggagccccgcttcatcgccgtggg
ctacgtggacgacacgcagttcgtgcggttcgacagcgacgccgcgagccagaggatggagccgTgggcgccgtgg
atagagcaggaggggccggagtattgggacgaggagacagggaaagtgaaggcccactcacagactgaccgagaga
acctgcggatcgcgctccgctactacaaccagagcgaggccggttctcacaccctccagatgatgtttggctgcga
cgtggggtcggacgggcgcttcctccgcgggtaccaccagtacgcctacgacggcaaggattacatcgccctgaaa
gaggacctgcgctcttggaccgcggcggacatggcggctcagatcaccaagcgcaagtgggaggcggcccatgtgg
cggagcagcagagagcctacctggagggcacgtgcgtggacgggctccgcagatacctggagaacgggaaggagac
gctgcagcgcacgg;

A*2437:
(SEQ ID NO: 141)
gctcccactccatgaggtatttctccacatccgtgtcccggcccggccgcggggagccccgcttcatcgccgtggg
ctacgtggacgacacgcagttcgtgcggttcgacagcgacgccgcgagccagaggatggagcTgcgggcgccgtgg
atagagcaggaggggccggagtattgggacgaggagacagggaaagtgaaggcccactcacagactgaccgagaga
acctgcggatcgcgctccgctactacaaccagagcgaggccggttctcacaccctccagatgatgtttggctgcga
cgtggggtcggacgggcgcttcctccgcgggtaccaccagtacgcctacgacggcaaggattacatcgccctgaaa
gaggacctgcgctcttggaccgcggcggacatggcggctcagatcaccaagcgcaagtgggaggcggcccatgtgg
cggagcagcagagagcctacctggagggcacgtgcgtggacgggctccgcagatacctggagaacgggaaggagac
gctgcagcgcacgg;

A*2438:
(SEQ ID NO: 142)
gctcccactccatgagCtatttctccacatccgtgtcccggcccggccgcggggagccccgcttcatcgccgtggg
ctacgtggacgacacgcagttcgtgcggttcgacagcgacgccgcgagccagaggatggagccgcgggcgccgtgg
atagagcaggaggggccggagtattgggacgaggagacagggaaagtgaaggcccactcacagactgaccgagaga
acctgcggatcgcgctccgctactacaaccagagcgaggccggttctcacaccctccagatgatgtttggctgcga
cgtggggtcggacgggcgcttcctccgcgggtaccaccagtacgcctacgacggcaaggattacatcgccctgaaa
gaggacctgcgctcttggaccgcggcggacatggcggctcagatcaccaagcgcaagtgggaggcggcccatgtgg
cggagcagcagagagcctacctggagggcacgtgcgtggacgggctccgcagatacctggagaacgggaaggagac
gctgcagcgcacgg;

-continued

A*2501:
(SEQ ID NO: 143)
atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccactcacagactgaccgagagaGcc tgcggatcgcgctccgctactacaaccagagcgaggacggttctcacaccatccagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagtggagagcctacctggagggccggtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggGaccttccagaagtgggcgtctgtggtggtgccttctggaCaggagca gagatacacctgccatgtgcagcatgagggtctgcccaagcccctcaccctgagatggggag;

A*2502:
(SEQ ID NO: 144)
atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccaGtcacagactgaccgagagaGcc tgcggatcgcgctccgctactacaaccagagcgaggacggttctcacaccatccagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagtggagagcctacctggagggccggtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggGaccttccagaagtgggcgtctgtggtggtgccttctggaCaggagca gagatacacctgccatgtgcagcatgagggtctgcccaagcccctcaccctgagatggggag;

A*2503:
(SEQ ID NO: 145)
gctcccactccatgaggtatttcttcacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccactcacagactgaccgagaga Gcctgcggatcgcgctccgctactacaaccagagcgaggacggttctcacaccatccagaggatgtatggctgcga cgtggggccggacgggcgcttcctccgcgggtaccagcaggacgcttacgacggcaaggattacatcgccctgaac gaggacctgcgctcttggaccgcggcggacatggcggctcagatcacccagcgcaagtgggagAcgcccatgAgg cggagcagTggagagcctacctggagggccggtgcgtggagTggctccgcagatacctggagaacgggaaggagac gctgcagcgcacgg;

A*2504:
(SEQ ID NO: 146)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccactcacagactgaccgagaga Gcctgcggatcgcgctccgctactacaaccagagcgaggacggttctcacaccatccagaggatgtatggctgcga -continued cgtggggccggacgggcgcttcctccgcgggtaccagcaggacgcttacgacggcaaggattacatcgccctgaac gaggacctgcgctcttggaccgcggcggacatggcggctcagatcacccagcgcaagtgggagacggcccatgAgg cggagcagcAgagagcctacctggagggccggtgcgtggagTggctccgcagatacctggagaacgggaaggagac gctgcagcgcacgg;

A*2601:

(SEQ ID NO: 147)
atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaaCacacggaatgtgaaggccactcacagactgaccgagcgaacc tggggaccctgcgcggctactacaaccagagcgaggacggttctcacaccatccagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagTggagagcctacctggagggccggtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggGaccttccagaagtgggcgtctgtggtggtgccttctggacaggagca gagatacacctgccatgtgcagcatgagggtctgcccaagcccctcaccctgagatgggag;

A*2602:

(SEQ ID NO: 148)
atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggccactcacagactgaccgagcgaacc tggggaccctgcgcggctactacaaccagagcgaggacggttctcacaccatccagaggatgtatggctgcgacgt ggggccggacgggcgcttcctccgcgggtaccagcagAacgcttacgacggcaaggattacatcgccctgaacgag gacctgcgctcttggaccgcggcggacatggcggctcagatcacccagcgcaagtgggagacggcccatgaggcgg agcagtggagagcctacctggagggccggtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggGaccttccagaagtgggcgtctgtggtggtgccttctggacaggagca gagatacacctgccatgtgcagcatgagggtctgcccaagcccctcaccctgagatgggag;

A*2603:

(SEQ ID NO: 149)
atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggccactcacagactCaccgagtgGacc tggggaccctgcgcggctactacaaccagagcgaggacggttctcacaccatccagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagTggagagcctacctggagggccggtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc

A*2604:

(SEQ ID NO: 150)

atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccactcacagactgaccgagcgaacc tggggaccctgcgcggctactacaaccagagcgaggacggttctcacaccatcagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagtggagagcctacctggagggccTgtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatgggDaccttccagaagtgggcgtctgtggtggtgccttctggacaggagca gagatacacctgccatgtgcagcatgagggtctgcccaagcccctcaccctgagatgggag;

A*2605:

(SEQ ID NO: 151)

atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccactcacagactgaccgagAgaacc tggggaccctgcgcggctactacaaccagagcgaggacggttctcacaccatccagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagTggagagcctacctggagggccggtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggGaccttccagaagtgggcgtctgtggtggtgccttctggacaggagca gagatacacctgccatgtgcagcatgagggtctgcccaagcccctcaccctgagatgggag;

A*2606:

(SEQ ID NO: 152)

gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccactcacagactcaccgagtgg acctggggaccctgcgcggctactacaaccagagcgaggacggttctcacaccatccagaggatgtatggctgcga cgtggggccggacgggcgcttcctccgcgggtaccagcGggacgcttacgacggcaaggattacatcgccctgaac gaggacctgcgctcttggaccgcggcggacatggcggctcagatcacccagcgcaagtgggagacggcccatgagg cggagcagtggagagcctacctggagggccggtgcgtggagtggctccgcagatacctggagaacgggaaggagac gctgcagcgcacgg;

A*2607:

(SEQ ID NO: 153)

atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta -continued cgtggacgacacgcagttcgtgcggttcgacagcgacgccgcgagccagaggatggagccgcgggcgccgtggata gagcaggaggggccggagtattgggacggggagacacggaaAgtgaaggcccactcacagactgaccgagcgaacc tggggaccctgcgcggctactacaaccagagcgaggacggttctcacaccatccagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagTggagagcctacctggagggccggtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggGaccttcagaagtgggcgtctgtggtggtgccttctggacaggagca gagatacacctgccatgtgcagcatgagggtctgcccaagcccctcaccctgagatgggag;

A*2608:

(SEQ ID NO: 154)
atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccactcacagactgaccgagcgaacc tggggaccctgcgcggctactacaaccagagcgaggacggttctcacaccatccagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagcAgagagcctacctggagggccggtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggGaccttcagaagtgggcgtctgtggtggtgccttctggacaggagca gagatacacctgccatgtgcagcatgagggtctgcccaagcccctcaccctgagatgggag;

A*2609:

(SEQ ID NO: 155)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccactcacagactgaccgagcga acctggggaccctgcgcggctactacaaccagagcgaggacggttctcacaccatccagaggatgtatggctgcga cgtggggccggacgggcgcttcctccgcgggtaccAgcaggacgcttacgacggcaaggattacatcgccctgaac gaggacctgcgctcttggaccgcggcggacatggcggctcagatcacCcagcgcaagtgggagAcggccatgAgg cggagcagtggagagcctacctggagggcaCgtgcgtggagtggctccgcagatacctggagaacgggaaggagac gctgcagcgcacgg;

A*2610:

(SEQ ID NO: 156)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccactcacagactgaccgagcga acctggggaccctgcgcggctactacaaccagagcgaggacggttctcacaccatccagaggatgtatggctgcga cgtggggccggacgggcgcttcctccgcgggtaccagcaggacgcttacgacggcaaggattacatcgccctgaaA gaggacctgcgctcttggaccgcggcggacatggcggctcagatcacCcagcgcaagtgggagAcggcccatgAgg cggagcagTggagagcctacctggagggccggtgcgtggagtggctccgcagatacctggagaacgggaaggagac gctgcagcgcacgg;

A*2612:
(SEQ ID NO: 157)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccactcacagactgaccgagcga acctggggaccctgcgcggctactacaaccagagcgaggacggttctcacaccatccagaggatgtatggctgcga cgtggggccggacgggcgcttcctccgcgggtaccagcaggacgcttacgacggcaaggattacatcgccctgaac gaggacctgcgctcttggaccgcggcggacatggcggctcagatcaccCagcgcaagtgggagAcggcccatgTgg cggagcagTggagagcctacctggagggccggtgcgtggagtggctccgcagatacctggagaacgggaaggagac gctgcagcgcacgg;

A*2613:
(SEQ ID NO: 158)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccaGtcacagactgaccgagcga acctggggaccctgcgcggctactacaaccagagcgaggacggttctcacaccatccagaggatgtatggctgcga cgtggggccggacgggcgcttcctccgcgggtaccAgcaggacgcttacgacggcaaggattacatcgccctgaac gaggacctgcgctcttggaccgcggcggacatggcggctcagatcaccCagcgcaagtgggagAcggcccatgAgg cggagcagTggagagcctacctggagggccggtgcgtggagtggctccgcagatacctggagaacgggaaggagac gctgcagcgcacgg;

A*2614:
(SEQ ID NO: 159)
gctcccactccatgaggtatttctacacCtccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaaCacacggaatgtgaaggcccactcacagactgaccgagcga acctggggaccctgcgcggctactacaaccagagcgaggacggttctcacaccatccagaggatgtatggctgcga cgtggggccggacgggcgcttcctccgcgggtaccAgcaggacgcTtacgacggcaaggattacatcgccctgaac gaggacctgcgctcttggaccgcggcggacatggcggctcagatcacccagcgcaagtgggaggcggcccatgAgg cggagcagTggagagcctacctggagggccggtgcgtggagtggctccgcagatacctggagaacgggaaggagac gctgcagcgcacgg;

A*2615:
(SEQ ID NO: 160)
atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttGgacagcgacgccgcgagccagaggatggagccgcgggcgccgtggata gagcaggaggggccggagtattgggaccggaacacacggaatgtgaaggcccactcacagactgaccgagcgaacc tggggaccctgcgcggctactacaaccagagcgaggacggttctcacaccatccagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagtggagagcctacctggagggccggtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggaaccttccagaagtgggcgtctgtggtggtgccttctggacaggagca gagatacacctgccatgtgcagcatgagggtctgcccaagcccctcacccctgagatgggag;

A*2616:
(SEQ ID NO: 161)
gctcccactccatgaggtatttctCcacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaaCacacggaatgtgaaggccactcacagactgaccgagcga acctggggaccctgcgcggctactacaaccagagcgaggacggttctcacaccatccagaggatgtatggctgcga cgtggggccggacgggcgcttcctccgcgggtaccAgcaggacgcttacgacggcaaggattacatcgccctgaac gaggacctgcgctcttggaccgcggcggacatggcggctcagatcacccAgcgcaagtgggagAcggcccatgAgg cggagcagTggagagcctacctggagggccggtgcgtggagtggctccgcagatacctggagaacgggaaggagac gctgcagcgcacgg;

A*2617:
(SEQ ID NO: 162)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggccactcacagactgaccgagcga acctggggaccctgcgcggctactacaaccagagcgaggacggtActcacaccatccagaggatgtatggctgcga cgtggggccggacgggcgcttcctccgcgggtaccagcaggacgcttacgacggcaaggattacatcgccctgaac gaggacctgcgctcttggaccgcggcggacatggcggctcagatcacccagcgcaagtgggagacggcccatgagg cggagcagtggagagcctacctggagggccggtgcgtggagtggctccgcagatacctggagaacgggaaggagac gctgcagcgcacgg;

A*2618:
(SEQ ID NO: 163)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggccactcacagactgaccgagcga acctggggaccctgcgcggctactacaaccagagcgaggacggttctcacaccatccagaggatgtatggctgcga cgtggggccggacgggcgcttcctccgcgggtaccAgcaggacgcTtacgacggcaaggattacatcgccctgaac gaggacctgcgctcttggaccgcggcggacatggcggctcagatcacccagcgcaagtgggaggcggcccGtgTgg cggagcagTggagagcctacctggagggccggtgcgtggagtggctccgcagatacctggagaacgggaaggagac gctgcagcgcacgg;

A*29010101:
(SEQ ID NO: 164)
atggccgtcatggcgccccgaaccctcctcctgctactcttgggggccctggccctgacccagacctgggcgggct cccactccatgaggtatttcaccacatccgtgtcccggcccggccgcggggagccccgcttcatcgccgtgggcta cgtggacgacacgcagttcgtgcggtttgacagcgacgccgcgagccagaggatggagccgcgggcaccgtggata gagcaggaggggccggagtattgggacctgcagacacggaatgtgaaggccagtcacagactgaccgagcgaacc tggggaccctgcgcggctactacaaccagagcgaggccggttctcacaccatccagatgatgtatggctgcCacgt ggggtcggacgggcgcttcctccgcgggtaccggcaggacgcctacgacggcaaggattacatcgccttgaacgag gacctgcgctcttggaccgcggcggacatggcggctcagatcacccagcgcaagtgggaggcggcccgtgtggcgg agcagttgagagcctacctggagggcacgtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc ttgtggagaccaggcctgcaggggatggaaccttccagaagtgggcgtctgtggtggtgccttctgacaggagca gagatacacctgccatgtgcagcatgagggtctgcccaagcccctcaccctgagatgggag;

A*2902:

(SEQ ID NO: 165)
atggccgtcatggcgccccgaaccctcctcctgctactcttgggggccctggccctgacccagacctgggcgggct cccactccatgaggtatttcaccacatccgtgtcccggcccggccgcggggagccccgcttcatcgccgtgggcta cgtggacgacacgcagttcgtgcggtttgacagcgacgccgcgagccagaggatggagccgcgggcAccgtggata gagcaggaggggccggagtattgggacctgcagacacggaatgtgaaggcccagtcacagactgaccgagcgaacc tggggaccctgcgcggctactacaaccagagcgaggccggttctcacaccatccagatgatgtatggctgcgacgt ggggtcggacgggcgcttcctccgcgggtaccggcaggacgcctacgacggcaaggattacatcgccttgaacgag gacctgcgctcttggaccgcggcggacatggcggctcagatcacccagcgcaagtgggaggcggcccgtgtggcgg agcagttgagagcctacctggagggcacgtgcgtggagTggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc ttgtggagaccaggcctgcaggggatggaaccttccagaagtgggcgtctgtggtggtgccttctggaCaggagca gagatacacctgccatgtgcagcatgagggtctgcccaagcccctcaccctgagatgggag;

A*2903:

(SEQ ID NO: 166)
atggccgtcatggcgccccgaaccctcctcctgctactcttgggggccctggccctgacccagacctgggcgggct cccactccatgaggtatttcaccacatccgtgtcccggcccggccgcggggagccccgcttcatcgccgtgggcta cgtggacgacacgcagttcgtgcggtttgacagcgacgccgcgagccagaggatggagccgcgggcAccgtggata gagcaggaggggccggagtattgggacctgcagacacggaatgtgaaggcccagtcacagactgaccgagcgaacc tggggaccctgcgcggctactacaaccagagcgaggccggttctcacaccatccagatgatgtatggctgcgacgt ggggtcggacgggcgcttcctccgcgggtaccggcaggacgcctacgacggcaaggattacatcgccttgaacgag gacctgcgctcttggaccgcggcggacatggcggctcagatcacccagcgcaagtgggaggcggcccgtgtggcgg agcagttgagagcctacctggagggcacgtgcgtggacgggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc ttgtggagaccaggcctgcaggggatggaaccttccagaagtgggcgtctgtggtggtgccttctggaCaggagca gagatacacctgccatgtgcagcatgagggtctgcccaagcccctcaccctgagatgggag;

A*2904:

(SEQ ID NO: 167)
gctcccactccatgaggtatttcaccacatccgtgtcccggcccggccgcggggagccccgcttcatcgccgtggg ctacgtggacgacacgcagttcgtgcggtttgacagcgacgccgcgagccagaggatggagccgcgggcaccgtgg atagagcaggaggggccggagtattgggacctgcagacacggCatgtgaaggcccagtcacagactgaccgagcga acctggggaccctgcgcggctactacaaccagagcgaggccggttctcacaccatccagatgatgtatggctgcga cgtggggtcggacgggcgcttcctccgcgggtaccggcaggacgcctacgacggcaaggattacatcgccttgaac gaggacctgcgctcttggaccgcggcggacatggcggctcagatcacccagcgcaagtgggaggcggcccGtgtgg cggagcagttgagagcctacctggagggcacgtgcgtggagtggctccgcagatacctggagaacgggaaggagac gctgcagcgcacgg;

A*2905:

(SEQ ID NO: 168)
gctcccactccatgaggtatttcaccacatccgtgtcccggcccggccgcggggagccccgcttcatcgccgtggg ctacgtggacgacacgcagttcgtgcggtttgacagcgacgccgcgagccagaggatggagccgcgggcAccgtgg atagagcaggaggggccggagtattgggacctgcagacacggaatgtgaaggcccagtcacagactgaccgagcga acctggggaccctgcgcggctactacaaccagagcgaggccggttctcacaccatccagatgatgtatggctgcga cgtggggtcggacgggcgcttcctccgcgggtaccggcaggacgcctacgacggcaaggattacatcgccttgaac gaggacctgcgctcttggaccgcggcggacatggcggctcagatcacccagcgcaagtgggaggcggcccatgagg cggagcagcAgagagcctacctggagggcacgtgcgtggagTggctccgcagatacctggagaacgggaaggagac gctgcagcgcacgg;

A*2906: (SEQ ID NO: 169)

gctcccactccatgaggtatttcaccacatccgtgtcccggcccggccgcggggagccccgcttcatcgccgtggg ctacgtggacgacacgcagttcgtgcggtttgacagcgacgccgcgagccagaggatggagccgcgggcAccgtgg atagagcaggaggggccggagtattgggacctgcagacacggaatgtgaaggcccagtcacagactgaccgagcga acctggggaccctgcgcggctactacaaccagagcgaggccggttctcacaccatccagatgatgtatggctgcga cgtggggtcggacgggcgcttcctccgcgggtaccggcaggacgcctacgacggcaaggattacatcgccttgaac gaggacctgcgctcttggaccgcggcggacatggcggctcagatcacccagcgcaagtgggaggcggcccgtgtgg cggagcagtTgagagcctacctggagggcacgtgcgtggagTggctccgcagatacctggagaacgggaaggagac gctgcagcgcgcgg;

A*2907: (SEQ ID NO: 170)

gctcccactccatgaggtatttcaccacatccgtgtcccggcccggccgcggggagccccgcttcatcgccgtggg ctacgtggacgacacgcagttcgtgcggtttgacagcgacgccgcgagccagaggatggagccgcgggcAccgtgg atagagcaggaggggccggagtattgggacctgcagacacggaatgtgaaggcccagtcacagactgaccgagcga acctggggaccctgcgcggctactacaaccagagcgaggccggttctcacaccctccagatgatgtTtggctgcga cgtggggtcggacgggcgcttcctccgcgggtaccggcaggacgcctacgacggcaaggattacatcgccttgaac gaggacctgcgctcttggaccgcggcggacatggcggctcagatcacccagcgcaagtgggaggcggcccgtgtgg cggagcagtTgagagcctacctggagggcacgtgcgtggagTggctccgcagatacctggagaacgggaaggagac gctgcagcgcacgg;

A*3001: (SEQ ID NO: 171)

atggccgtcatggcgccccgaaccctcctcctgctactctcgggggccctggccctgacccagacctgggcgggct cccactccatgaggtatttctCcacatccgtgtcccggcccggcagtggagagccccgcttcatcgcagtgggcta cgtggacgacacgcagttcgtgcggttcgacagcgacgccgcgagccagaggatggagccgcgggcgccgtggata gagcaggagaggccTgagtattgggaccaggagacacggaatgtgaaggcccagtcacagactgaccgagtggacc tggggaccctgcgcggctactacaaccagagcgaggccggttctcacaccatccagataatgtatggctgcgacgt ggggtcggacgggcgcttcctccgcgggtatgaacagcacgcctacgacggcaaggattacatcgccctgaacgag gacctgcgctcttggaccgcggcggacatggcggctcagatcacccagcgcaagtgggaggcggcccgtTgggcgg agcagttgagagcctacctggagggcacgtgcgtggagtggctccgcagatacctggagaacgggaaggagacgct gcagcgcacggaccccccaagacacatatgacccaccacccatctctgaccatgaggccaccctgaggtgctgg gccctgggcttctaccctgcggagatcacactgacctggcagcgggatgggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatgggag;

A*3002: (SEQ ID NO: 172)

atggccgtcatggcgccccgaaccctcctcctgctactctcgggggccctggccctgacccagacctgggcgggct cccactccatgaggtatttctccacatccgtgtcccggcccggcagtggAgagccccgcttcatcgcagtgggcta cgtggacgacacgcagttcgtgcggttcgacagcgacgccgcgagccagaggatggagccgcgggcgccgtggata gagcaggagaggccTgagtattgggaccaggagacacggaatgtgaaggcccactcacagactgaccgagagaacc tggggaccctgcgcggctactacaaccagagcgaggccggttctcacaccatccagataatgtatggctgcgacgt ggggtcggacgggcgcttcctccgcgggtatgaacagcacgcctacgacggcaaggattacatcgccctgaacgag gacctgcgctcttggaccgcggcggacatggcggctcagatcacccagcgcaagtgggaggcggcccgtCgggcgg agcagttgagagcctacctggagggcaCgtgcgtggagTggctccgcagatacctggagaacgggaaggagacgct gcagcgcacggacccccccaagacacatatgacccaccaccccatctctgaccatgaggccaccctgaggtgctgg gccctgggcttctaccctgcggagatcacactgacctggcagcgggatggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatgggag;

A*3003:
(SEQ ID NO: 173)
ggctcccactccatgaggtatttctccacatccgtgtcccggcccggcagtggAgagccccgcttcatcgcagtgg gctacgtggacgacacgcagttcgtgcggttcgacagcgacgccgcgagccagaggatggagccgcgggcgccgtg gatagagcaggaggggccggagtattgggaccaggagacacggaatgtgaaggcccactcacagactgaccgagag aacctggggaccctgcgcggctactacaaccagagcgaggccggttctcacaccatccagataatgtatggctgcg acgtgggtcggacgggcgcttcctccgcgggtatgaacagcacgcctacgacggcaaggattacatcgccctgaa cgaggacctgcgctcttggaccgcggcggacatggcggctcagatcacccagcgcaagtgggaggcggcccgtCgg gcggagcagttgagagcctacctggagggcaCgtgcgtggagTggctccgcagatacctggagaacgggaaggaga cgctgcagcgcacggacccccccaagacacatatgacccaccaccccatctctgaccatgaggccaccctgaggtg ctgggccctgggcttctaccctgcggagatcacactgacctggcagcgggatggggaggaccagacccaggacacg gagctcgtggagaccaggcctgcaggggatggaaccttccagaagtgggcggctgtggtggtgccttctggagagg agcagag;

A*3004:
(SEQ ID NO: 174)
gctcccactccatgaggtatttctccacatccgtgtcccggcccggcagtggAgagccccgcttcatcgcagtggg ctacgtggacgacacgcagttcgtgcggttcgacagcgacgccgcgagccagaggatggagccgcgggcgccgtgg atagagcaggagaggcctgagtattgggaccaggagacacggaatgtgaaggcccactcacagactgaccgagaga acctggggaccctgcgcggctactacaaccagagcgaggccggttctcacaccatccagataatgtatggctgcga cgtgggtcggacgggcgcttcctccgcgggtatgaacagcacgcctacgacggcaaggattacatcgccctgaac gaggacctgcgctcttggaccgcggcggacatggcggctcagatcacccagcgcaagtgggaggcggcccatgTgg cggagcagtggagagcctacctggagggcacgtgcgtggagTggctccgcagatacctggagaacgggaaggagac gctgcagcgcacgg;

A*3006:
(SEQ ID NO: 175)
gctcccactccatgaggtatttctccacatccgtgtcccggcccggcagtggagagccccgcttcatcgcagtggg ctacgtggacgacGcgcagttcgtgcggttcgacagcgacgccgcgagccagaggatggagccgcgggcgccgtgg atagagcaggagaggcctgagtattgggaccaggagacacggaatgtgaaggcccactcacagactgaccgagaga acctggggaccctgcgcggctactacaaccagagcgaggccggttctcacaccatccagataatgtatggctgcga cgtggggtcggacgggcgcttcctccgcgggtatgaacagcacgcctacgacggcaaggattacatcgccctgaac gaggacctgcgctcttggaccgcggcggacatggcggctcagatcacccagcgcaagtgggaggcggcccatgtgg cggagcagtggagagcctacctggagggcacgtgcgtggagtggctccgcagatacctggagaacgggaaggagac gctgcagcgcacgg;

A*3007:
(SEQ ID NO: 176)
gctcccactccatgaggtatttctccacatccgtgtcccggcccggcagtggagagccccgcttcatcgcagtggg ctacgtggacgacacgcagttcgtgcggttcgacagcgacgccgcgagccagaggatggagccgcgggcgccgtgg -continued atagagcaggagaggcctgagtattgggacgaggagacagggaaAgtgaaggcccactcacagactgaccgagaga
acctggggaccctgcgcggctactacaaccagagcgaggccggttctcacaccatccagataatgtatggctgcga
cgtggggtcggacgggcgcttcctccgcgggtatgaacagcacgcctacgacggcaaggattacatcgccctgaac
gaggacctgcgctcttggaccgcggcggacatggcggctcagatcacccagcgcaagtgggaggcggcccgtCggg
cggagcagttgagagcctacctggagggcaCgtgcgtggagTggctccgcagatacctggagaacgggaaggagac
gctgcagcgcacgg;

A*3008:
(SEQ ID NO: 177)
atggccgtcatggcgccccgaaccctcctcctgctactctcgggggccctggccctgacccagacctgggcgggct
ctcactccatgaggtatttctacacCtccgtgtcccggcccggcagtggagagccccgcttcatcgcagtgggcta
cgtggacgacacgcagttcgtgcggttcgacagcgacgccgcgagccagaggatggagccgcgggcgccgtggata
gagcaggagaggccTgagtattgggaccaggagacacggaatgtgaaggccagtcacagactgaccgagtggacc
tggggaccctgcgcggctactacaaccagagcgaggccggttctcacaccatccagataatgtatggctgcgacgt
ggggtcggacgggcgcttcctccgcgggtatgaacagcacgcctacgacggcaaggattacatcgccctgaacgag
gacctgcgctcttggaccgcggcggacatggcggctcagatcacccagcgcaagtgggaggcggcccgtTgggcgg
agcagttgagagcctacctggagggcacgtgcgtggagtggctccgcagatacctggagaacgggaaggagacgct
gcagcgcacggaccccccaagacacatatgacccaccacccatctctgaccatgaggccaccctgaggtgctgg
gccctgggcttctaccctgcggagatcacactgacctggcagcgggatggggaggaccagacccaggacacggagc
tcgtggagaccaggcctgcaggggatggaaccttccagaagtgggcggctgtggtggtgccttctggagaggagca
gagatacacctgccatgtgcagcatgagggtctgcccaagcccctcaccctgagatgggag;

A*3009:
(SEQ ID NO: 178)
gctcccactccatgaggtatttctccacatccgtgtcccggcccggcagtggAgagccccgcttcatcgcagtggg
ctacgtggacgacacgcagttcgtgcggttcgacagcgacgccgcgagccagaggatggagccgcgggcgccgtgg
atagagcaggagaggcctgagtattgggaccaggagacacggaatgtgaaggcccactcacagactgaccgagaga
acctggggaccctgcgcggctactacaaccagagcgaggccggttctcacaccatccagataatgtatggctgcga
cgtggggtcggacgggcgcttcctccgcgggtatgaacagcacgcctacgacggcaaggattacatcgccctgaac
gaggacctgcgctcttggaccgcggcggacatggcggctcagatcacccagcgcaagtgggaggcggcccgtTgg
cggagcagtTgagagcctacctggagggcacgtgcgtggagTggctccgcagatacctggagaacgggaaggagac
gctgcagcgcacgg;

A*3010:
(SEQ ID NO: 179)
gctcccactccatgaggtatttctccacatccgtgtcccggcccggcagtggagagccccgcttcatcgcagtggg
ctacgtggacgacacgcagttcgtgcggttcgacagcgacgccgcgagccagaggatggagccgcgggcgccgtgg
atagagcaggagaggcctgagtattgggaccaggagacacggaatgtgaaggcccactcacagactgaccgagaga
acctggggaccctgcgcggctactacaaccagagcgaggccggttctcacaccatccagataatgCatggctgcga
cgtggggtcggacgggcgcttcctccgcgggtatgaacagcacgcctacgacggcaaggattacatcgccctgaac
gaggacctgcgctcttggaccgcggcggacatggcggctcagatcacccagcgcaagtgggaggcggcccgtcggg
cggagcagttgagagcctacctggagggcacgtgcgtggagtggctccgcagatacctggagaacgggaaggagac
gctgcagcgcacggaccccccaagacacatatgacccaccacccatctctgaccatgaggccaccctgaggtgc
tgggccctgggcttctaccctgcggagatcacactgacctggcagcgggatggggaggaccagacccaggacacgg
agctcgtggagaccaggcctgcaggggatggaaccttccagaagtgggcggctgtggtggtgccttctggagagga
gcagagatacacctgccatgtgcagcatgagggtctgcccaagcccctcaccctgagatggg;

A*3011:
(SEQ ID NO: 180)
gctcccactccatgaggtatttctCcacatccgtgtcccggcccggcagtggagagccccgcttcatcgcagtggg ctacgtggacgacacgcagttcgtgcggttcgacagcgacgccgcgagccagaggatggagccgcgggcgccgtgg atagagcaggagggccggagtattgggaccaggagacacggaatgtgaaggcccagtcacagactgaccgagtgg acctggggaccctgcgcggctactacaaccagagcgaggccggttctcacaccatccagataatgtatggctgcga cgtggggtcggacgggcgcttcctccgcgggtatgaacagcacgcctacgacggcaaggattacatcgccctgaac gaggacctgcgctcttggaccgcggcggacatggcggctcagatcacccagcgcaagtgggaggcggcccgtTggg cggagcagttgagagcctacctggagggcacgtgcgtggagtggctccgcagatacctggagaacgggaaggagac gctgcagcgcacgg;

A*3012:
(SEQ ID NO: 181)
gctcccactccatgaggtatttctccacatccgtgtcccggcccggccgcggggagccccgcttcatcgcagtggg ctacgtggacgacacgcagttcgtgcggttcgacagcgacgccgcgagccagaggatggagccgcgggcgccgtgg atagagcaggagaggccTgagtattgggaccaggagacacggaatgtgaaggcccactcacagactgaccgagaga acctggggaccctgcgcggctactacaaccagagcgaggccggttctcacaccatccagataatgtatggctgcga cgtggggtcggacgggcgcttcctccgcgggtatgaacagcacgcctacgacggcaaggattacatcgccctgaac gaggacctgcgctcttggaccgcggcggacatggcggctcagatcacccagcgcaagtgggaggcggcccgtCggg cggagcagttgagagcctacctggagggcaCgtgcgtggagTggctccgcagatacctggagaacgggaaggagac gctgcagcgcacggaccccccaagacacatatgacccaccaccccatctctgaccatgaggccaccctgaggtgc tgggccctgggcttctaccctgcggagatcacactgacctggcagcgggatggggaggaccagacccaggacacgg agctcgtggagaccaggcctgcaggggatggaaccttccagaagtgggcggctgtggtggtgccttctggagagga gcagagatacacctgccatgtgcagcatgagggtctgcccaagcccctcaccctgagatggg;

A*310102:
(SEQ ID NO: 182)
atggccgtcatggcgccccgaaccctcctcctgctactcttgggggccctggccctgacccagacctgggcgggct cccactccatgaggtatttcaccacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggagaggccTgagtattgggaccaggagacacggaatgtgaaggcccactcacagattgaccgagtggacc tggggaccctgcgcggctactacaaccagagcgaggccggttctcacaccatccagatgatgtatggctgcgacgt ggggtcggacgggcgcttcctccgcgggtaccagcaggacgcctacgacggcaaggattacatcgccTtgaacgag gacctgcgctcttggaccgcggcggacatggcggctcagatcacccagcgcaagtgggaggcggcccgtgtggcgg agcagttgagagcctacctggagggcacgtgcgtggagtggctccgcagatacctggagaacgggaaggagacgct gcagcgcacggaccccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggaaccttccagaagtgggcgtctgtggtggtgccttctggacaggagca gagatacacctgccatgtgcagcatgagggtctCcccaagcccctcaccctgagatgggag;

A*3102:
(SEQ ID NO: 183)
gctcccactccatgaggtatttcaccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggagaggcctgagtattgggaccaggagacacggaaAgtgaaggcccactcacagaTtgaccgagtgg acctggggaccctgcgcggctactacaaccagagcgaggccggttctcacaccatccagatgatgtatggctgcga cgtggggTcggacgggcgcttcctccgcgggtaccAgcaggacgcctacgacggcaaggattacatcgccTtgaac -continued gaggacctgcgctcttggaccgcggcggacatggcggctcagatcacccagcgcaagtgggaggcggcccGtgtgg cggagcagtTgagagcctacctggagggcacgtgcgtggagTggctccgcagatacctggagaacgggaaggagac gctgcagcgcacgg;

A*3103:                                                                      (SEQ ID NO: 184)
gctcccactccatgaggtatttcaccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggagaggcctgagtattgggaccaggagacacggaatgtgaaggcccactcacagaTtgaccgagtgg acctggggaccctgcgcggctactacaaccagagcgaggacggttctcacaccatccagataatgtatggctgcga cgtggggtcggacgggcgcttcctccgcgggtaccggcaggacgcTtacgacggcaaggattacatcgccctgaac gaggacctgcgctcttggaccgcggcggacatggcggctcagatcacccagcgcaagtgggaggcggcccGtgtgg cggagcagtTgagagcctacctggagggcacgtgcgtggagTggctccgcagatacctggagaacgggaaggagac gctgcagcgcacgg;

A*3104:                                                                      (SEQ ID NO: 185)
atggccgtcatggcgccccgaaccctcctcctgctactcttgggggccctggccctgacccagacctgggcgggct cccactccatgaggtatttcaccacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggagaggcctgagtattgggaccaggagacacggaatgtgaaggcccactcacagattgaccgagtggacc tggggaccctgcgcggctactacaaccagagcgaggccggttctcacaccatccagataatgtatggctgcgacgt ggggtcggacgggcgcttcctccgcgggtaccggcaggacgcTtacgacggcaaggattacatcgccctgaacgag gacctgcgctcttggaccgcggcggacatggcggctcagatcacccagcgcaagtgggaggcggcccgtgtggcgg agcagttgagagcctacctggagggcacgtgcgtggagtggctccgcagatacctggagaacgggaaggagacgct gcagcgcacggaccccccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggaaccttccagaagtgggcgtctgtggtggtgccttctggacaggagca gagatacacctgccatgtgcagcatgagggtctCcccaagcccctcaccctgagatgggag;

A*3105:                                                                      (SEQ ID NO: 186)
gctcccactccatgaggtatttcaccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggagaggccTgagtattgggaccaggagacacggaatgtgaaggcccactcacagaTtgaccgagtgg acctggggaccctgcgcggctactacaaccagagcgaggccggttctcacaccatccagatgatgtatggctgcga cgtggggTcggacgggcgcttcctccgcgggtaccAgcaggacgcctacgacggcaaggattacatcgccTtgaac gaggacctgcgctcttggaccgcggcggacatggcggctcagatcacccagcgcaagtgggaggcggcccGtgtgg cggagcagtTgagagcctacctggagggcacgtgcgtggacgggctccgcagatacctggagaacgggaaggagac gctgcagcgcacgg;

A*3106:                                                                      (SEQ ID NO: 187)
gctcccactccatgaggtatttcaccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggagaggccTgagtattgggaccaggagacacggaatgtgaaggcccactcacagaTtgaccgagtgg acctggggaccctgcgcggctactacaaccagagcgaggccggttctcacaccatccagatgatgtatggctgcga cgtggggTcggacgggcgcttcctccgcgggtaccggcaggacgcctacgacggcaaggattacatcgccTtgaac gaggacctgcgctcttggaccgcggcggacatggcggctcagatcacccagcgcaagtgggaggcggcccGtgtgg cggagcagtTgagagcctacctggagggcacgtgcgtggagTggctccgcagatacctggagaacgggaaggagac gctgcagcgcacgg;

A*3107:

(SEQ ID NO: 188)

gctcccactccatgaggtatttcaccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggagaggccTgagtattgggaccaggagacacggaaagtgaaggcccactcacagactgaccgagaga acctgcggatcgcgctcCgctactacaaccagagcgaggccggttctcacaccatccagatgatgtatggctgcga cgtggggtcggacgggcgcttcctccgcgggtaccAgcaggacgcctacgacggcaaggattacatcgccTtgaac gaggacctgcgctcttggaccgcggcggacatggcggctcagatcacccagcgcaagtgggaggcggcccgtgTgg cggagcagtTgagagcctacctggagggcacgtgcgtggagTggctccgcagatacctggagaacgggaaggagac gctgcagcgcacgg;

A*3108:

(SEQ ID NO: 189)

gctcccactccatgaggtatttcAccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacgaggagacaGggaaagtgaaggcccactcacagactgaccgagaga acctgcggatcgcgctcCgctactacaaccagagcgaggccggttctcacaccatccagatgatgtatggctgcga cgtggggtcggacgggcgcttcctccgcgggtaccAgcaggacgcctacgacggcaaggattacatcgccTtgaac gaggacctgcgctcttggaccgcggcggacatggcggctcagatcacccagcgcaagtgggaggcggcccgtgtgg cggagcagtTgagagcctacctggagggcacgtgcgtggagTggctccgcagatacctggagaacgggaaggagac gctgcagcgcacgg;

A*3109:

(SEQ ID NO: 190)

gctcccactccatgaggtatttcaccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggagaggcctgagtattgggaccaggagacacggaatgtgaaggGccactcacagattgaccgagtgg acctggggaccctgcgcggctactacaaccagagcgaggccggttctcacaccatccagatgatgtatggctgcga cgtggggtcggacgggcgcttcctccgcgggtaccagcaggacgcctacgacggcaaggattacatcgccttgaac gaggacctgcgctcttggaccgcggcggacatggcggctcagatcacccagcgcaagtgggaggcggcccgtgtgg cggagcagttgagagcctacctggagggcacgtgcgtggagtggctccgcagatacctggagaacgggaaggagac gctgcagcgcacgg;

A*3201:

(SEQ ID NO: 191)

atggccgtcatggcgccccgaaccctcctcctgctactcttgggggccctggccctgacccagacctgggcgggct cccactccatgaggtatttcttcacatccgtgtcccggcccggccgcggggagccccgcttcatcgccgtgggcta cgtggacgacacgcagttcgtgcggttTgacagcgacgccgcgagccagaggatggagccgcgggcgccgtggata gagcaggaggggccggagtattgggaccaggagacacggaatgtgaaggcccactcacagactgaccgagagaGcc tgcggatcgcgctccgctactacaaccagagcgaggccggttctcacaccatccagatgatgtatggctgcgacgt ggggccggacgggcgcctcctccgcgggtaccagcaggacgcctacgacggcaaggattacatcgccttgaacgag gacctgcgctcttggaccgcggcggacatggcggctcagatcacccagcgcaagtgggaggcggcccgtgtggcgg agcagtTgagagcctacctggagggcacgtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc tTgtggagaccaggcctgcaggggatggaaccttccagaagtgggcgtctgtggtggtgccttctggaCaggagca gagatacacctgccatgtgcagcatgagggtctgcccaagcccctcaccctgagatgggag;

A*3202:

(SEQ ID NO: 192)
atggccgtcatggcgccccgaaccctcctcctgctactcttgggggccctggccctgacccagacctgggcgggct cccactccatgaggtatttcttcacatccgtgtcccggcccggccgcggggagccccgcttcatcgccgtgggcta cgtggacgacacgcagttcgtgcggtttgacagcgacgccgcgagccagaggatggagccgcgggcgccgtggata gagcaggaggggccggagtattgggaccaggagacacggaatgtgaaggcccactcacagactgaccgagagaGcc tgcggatcgcgctccgctactacaaccagagcgaggccggttctcacaccatccagatgatgtatggctgcgacgt ggggccggacgggcgcctcctccgcgggtaccagcaggacgcctacgacggcaaggattacatcgccttgaacgag gacctgcgctcttggaccgcggcggacatggcggctcagatcacccagcgcaagtgggaggcggcccatgtggcgg agcagcAgagagcctacctggagggcacgtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc tTgtggagaccaggcctgcaggggatggaaccttccagaagtgggcgtctgtggtggtgccttctggaCaggagca gagatacacctgccatgtgcagcatgagggtctgcccaagcccctcaccctgagatgggag;

A*3203:

(SEQ ID NO: 193)
gctcccactccatgaggtatttcttcacatccgtgtcccggcccggccgcggggagccccgcttcatcgccgtggg ctacgtggacgacacgcagttcgtgcggtttgacagcgacgccgcgagccagaggatggagccgcgggcgccgtgg atagagcaggaggggccggagtattgggaccaggagacacggaatgtgaaggcccactcacagactgaccgagaga acctgcggatcgcgctcCgctactacaaccagagcgaggccggttctcacaccatccagatgatgtatggctgcga cgtggggccggacgggcgcCtcctccgcgggtaccagcaggacgcctacgacggcaaggattacatcgccttgaac gaggacctgcgctcttggaccgcggcggacatggcggctcagatcacccagcgcaagtgggaggcggcccGtgtgg cggagcagtTgagagcctacctggagggcacgtgcgtggagtggctccgcagatacctggagaacgggaaggagac gctgcagcgcacgg;

A*3204:

(SEQ ID NO: 194)
gctcccactccatgaggtatttcttcacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccaggagacacggaatgtgaaggcccactcacagactgaccgagaga Gcctgcggatcgcgctccgctactacaaccagagcgaggccggttctcacaccatccagataatgtatggctgcga cgtggggtcggacgggcgcttcctccgcgggtaccggcaggacgcctacgacggcaaggattacatcgccctgaac gaggacctgcgctcttggaccgcggcggacatggcggctcagatcaccaagcgcaagtgggaggcggcccatgagg cggagcagttgagagcctacctggaTggcaCgtgcgtggagTggctccgcagatacctggagaacgggaaggagac gctgcagcgcacgg;

A*3205:

(SEQ ID NO: 195)
atggccgtcatggcgccccgaaccctcctcctgctactcttgggggccctggccctgacccagacctgggcgggct cccactccatgaggtatttcttcacatccgtgtcccggcccggccgcggggagccccgcttcatcgccgtgggcta cgtggacgacacgcagttcgtgcggtttgacagcgacgccgcgagccagaggatggagccgcgggcgccgtggata gagcaggaggggccggagtattgggaccaggagacagggaaAgtgaaggcccactcacagactgaccgagagaGcc tgcggatcgcgctccgctactacaaccagagcgaggccggttctcacaccatccagatgatgtatggctgcgacgt ggggccggacgggcgcctcctccgcgggtaccagcaggacgcctacgacggcaaggattacatcgccttgaacgag gacctgcgctcttggaccgcggcggacatggcggctcagatcacccagcgcaagtgggaggcggcccGtgtggcgg

A*3206:

(SEQ ID NO: 196)
gctcccactccatgaggtatttcttcacatccgtgtcccggcccggccgcggggagccccgcttcatcgccgtggg ctacgtggacgacacgcagttcgtgcggtttgacagcgacgccgcgagccagaggatggagccgcgggcgccgtgg atagagcaggaggggccggagtattgggaccaggagacacggaatgtgaaggcccactcacagactgaccgagaga Gcctgcggatcgcgctccgctactacaaccagagcgaggccggttctcacaccatccagatgatgtatggctgcga cgtggggccggacgggcgcctcctccgcgggtaccagcaggacgcctacgacggcaaggattacatcgccttgaac gaggacctgcgctcttggaccgcggcggacatggcggctcagatcacccagcgcaagtgggaggcggcccatgTgg cggagcagtTgagagcctacctggagggcaCgtgcgtggagTggctccgcagatacctggagaacgggaaggagac gctgcagcgcacgg;

A*3207:

(SEQ ID NO: 197)
gctcccactccatgaggtatttctCcacatccgtgtcccggcccggccgcggggagccccgcttcatcgccgtggg ctacgtggacgacacgcagttcgtgcggtttgacagcgacgccgcgagccagaggatggagccgcgggcgccgtgg atagagcaggaggggccggagtattgggaccaggagacacggaatgtgaaggcccactcacagactgaccgagaga Gcctgcggatcgcgctccgctactacaaccagagcgaggccggttctcacaccatccagatgatgtatggctgcga cgtggggccggacgggcgcctcctccgcgggtaccagcaggacgcctacgacggcaaggattacatcgccttgaac gaggacctgcgctcttggaccgcggcggacatggcggctcagatcacccagcgcaagtgggaggcggcccGtgTgg cggagcagtTgagagcctacctggagggcaCgtgcgtggagTggctccgcagatacctggagaacgggaaggagac gctgcagcgcacgg;

A*3301:

(SEQ ID NO: 198)
atggccgtcatggcgccccgaaccctcctcctgctactcttgggggccctggccctgacccagacctgggcgggct cccactccatgaggtatttcaccacatccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccactcacagattgaccgagtggacc tggggaccctgcgcggctactacaaccagagcgaggccggttctcacaccatccagatgatgtatggctgcgacgt ggggtcggacgggcgcttcctccgcgggtaccagcaggacgcctacgacggcaaggattacatcgccttgaacgag gacctgcgctcttggaccgcggcggacatggcggctcagatcacccagcgcaagtgggaggcggcccgtgtggcgg agcagttgagagcctacctggagggcacgtgcgtggagtggctccgcagacacctggagaacgggaaggagacgct gcagcgcacggacccccccaGgacgcatatgactcaccacgctgtctctgaccatgaggccaccctgaggtgctgg gccctgagcttctaccctgcggagatcacactgacctggcagcgggatgggaggaccagacccaggacacggagc tcgtggagaccaggcctgcaggggatggaaccttccagaagtgggcgtctgtggtggtgccttctggacaggagca gagatacacctgccatgtgcagcatgagggtctccccaagcccctcaccctgagatgggag;

A*3303:

(SEQ ID NO: 199)
atggccgtcatggcgccccgaaccctcctcctgctactcttgggggccctggccctgacccagacctgggcgggct cccactccatgaggtatttcaccacatccgtgtcccggcccggccgcggggagccccgcttcatcgccgtgggcta cgtggacgacacgcagttcgtgcggttcgacagcgacgccgcgagccagaggatggagccgcgggcgccgtggata -continued gagcaggaggggccggagtattgggaccggaaCacacggaatgtgaaggcccactcacagattgaccgagtggacc tggggaccctgcgcggctactacaaccagagcgaggccggttctcacaccatccagatgatgtatggctgcgacgt ggggtcggacgggcgcttcctccgcgggtaccagcaggacgcctacgacggcaaggattacatcgccTtgaacgag gacctgcgctcttggaccgcggcggacatggcggctcagatcacccagcgcaagtgggaggcggcccgtgtggcgg agcagttgagagcctacctggagggcacgtgcgtggagtggctccgcagatacctggagaacgggaaggagacgct gcagcgcacggaccccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggaaccttccagaagtgggcgtctgtggtggtgccttctggacaggagca gagatacacctgccatgtgcagcatgagggtctCcccaagcccctcaccctgagatgggag;

A*3304:
(SEQ ID NO: 200)
gctcccactccatgaggtatttcaccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccactcacagattgaccgagtgg acctggggaccctgcgcggctactacaaccagagcgaggccggttctcacaccatccagatgatgtatggctgcga cgtggggtcggacgggcgcttcctccgcgggtaccagcaggacgcctacgacggcaaggattacatcgccttgaac gaggacctgagctcCtggaccgcggcggacatggcggctcagatcacccagcgcaagtgggaggcggcccgtgtgg cggagcagttgagagcctacctggagggcacgtgcgtggagtggctccgcagacacctggagaacgggaaggagac gctgcagcgcacgg;

A*3305:
(SEQ ID NO: 201)
gctcccactccatgaggtatttcaccacatccgtgtcccggcccggccgcggggagccccgcttcatcgccgtggg ctacgtggacgacacgcagttcgtgcggttcgacagcgacgccgcgagccagaggatggagccgcgggcgccgtgg atagagcGggaggggccggagtattgggaccggaacacacggaatgtgaaggcccactcacagattgaccgagtgg acctggggaccctgcgcggctactacaaccagagcgaggccggttctcacaccatccagatgatgtatggctgcga cgtggggtcggacgggcgcttcctccgcgggtaccagcaggacgcctacgacggcaaggattacatcgccttgaac gaggacctgcgctcttggaccgcggcggacatggcggctcagatcacccagcgcaagtgggaggcggcccgtgtgg cggagcagttgagagcctacctggagggcacgtgcgtggagtggctccgcagacacctggagaacgggaaggagac gctgcagcgcacgg;

A*3306:
(SEQ ID NO: 202)
gctcccactccatgaggtatttcaccacatccgtgtcccggcccggccgcggggagccccgcttcatcgccgtggg ctacgtggacgacacgcagttcgtgcggttcgacagcgacgccgcgagccagaggatggagccgcgggcgccgtgg atGgagcaggaggggccggagtattgggaccggaacacacggaatgtgaaggcccactcacagattgaccgagtgg acctggggaccctgcgcggctactacaaccagagcgaggccggttctcacaccatccagatgatgtatggctgcga cgtggggtcggacgggcgcttcctccgcgggtaccagcaggacgcctacgacggcaaggattacatcgccttgaac gaggacctgcgctcttggaccgcggcggacatggcggctcagatcacccagcgcaagtgggaggcggcccgtgtgg cggagcagttgagagcctacctggagggcacgtgcgtggagtggctccgcagatacctggagaacgggaaggagac gctgcagcgcacggacccccccaagacgcatatgactcaccacgctgtctctgaccatgaggccaccctgaggtgc tgggccctgagcttctaccctgcggagatcacactgacctggcagcgggatggggaggaccagacccaggacacgg agctcgtggagaccaggcctgcaggggatggaaccttccagaagtgggcgtctgt;

A*3401:
(SEQ ID NO: 203)
atggccatcatggcgccccgaaccctcgtcctgctactctcgggggcccctggccctgacccagacctgggcgggct cccactccatgaggtatttctacacctccgtgtcccggcccggccgcggggagccccgcttcatcgccgtgggcta -continued cgtggacgacacgcagttcgtgcggttcgacagcgacgccgcgagccagaggatggagccgcgggcgccgtggata gagcaggaggggccggagtattgggaccggaacacacggaaagtgaaggcccagtcacagactgaccgagtggacc tggggaccctgcgcggctactacaaccagagcgaggacggttctcacaccatccagaggatgtatggctgcgacgt ggggccggacgggcgcttcctccgcgggtaccAgcaggacgcttacgacggcaaggattacatcgccctgaacgag gacctgcgctcttggaccgcggcggacatggcggctcagatcacccagcgcaagtgggagacggcccatgAggcgg agcagTggagagcctacctggagggcaCgtgcgtggagTggctccgcagatacctggagaacgggaaggagacgct gcagcgcacggacGcccccaagacacatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggaaccttccagaagtgggcgTctgtggtggtgccttctggaCaggagca gagatacacctgccatgtgcagcatgagggtctgcccaagcccctcaccctgagatgggag;

A*3402:
(SEQ ID NO: 204)
atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccagtcacagactgaccgagtggacc tggggaccctgcgcggctactacaaccagagcgaggacggttctcacaccatccagataatgtatggctgcgacgt ggggtcggacgggcgcttcctccgcgggtaccggcaggacgcttacgacggcaaggattacatcgccctgaacgag gacctgcgctcttggaccgcggcggacatggcggctcagatcacccagcgcaagtgggagacggcccatgAggcgg agcagtTgagagcctacctggagggcaCgtgcgtggagTggctccgcagatacctggagaacgggaaggagacgct gcagcgcacggacGcccccaagacGcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggaaccttccagaagtgggcgTctgtggtggtgccttctggaCaggagca gagatacacctgccatgtgcagcatgagggtctgcccaagcccctcaccctgagatgggag;

A*3403:
(SEQ ID NO: 205)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccagtcacagactgaccgagtgg acctggggaccctgcgcggctactacaaccagagcgaggacggttctcacaccatccagataatgtatggctgcga cgtggggtcggacgggcgcttcctccgcgggtaccggcaggacgcTtacgacggcaaggattacatcgccctgaac gaggacctgcgctcttggaccgcggcggacatggcggctcagatcacccagcgcaagtgggaggcggcccatgAgg cggagcagtTgagagcctacctggagggcaCgtgcgtggagtggctccgcagatacctggagaacgggaaggagac gctgcagcgcacgg;

A*3404:
(SEQ ID NO: 206)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggagAggccggagtattgggaccggaacacacggaatgtgaaggcccagtcacagactgaccgagtgg acctggggaccctgcgcggctactacaaccagagcgaggacggttctcacaccatccagataatgtatggctgcga cgtggggtcggacgggcgcttcctccgcgggtaccggcaggacgcttacgacggcaaggattacatcgccctgaac gaggacctgcgctcttggaccgcggcggacatggcggctcagatcacccagcgcaagtgggagacggcccatgAgg -continued cggagcagtTgagagcctacctggagggcacgtgcgtggagTggctccgcagatacctggagaacgggaaggagac gctgcagcgcacgg;

A*3405:

(SEQ ID NO: 207)

gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaaagtgaaggcccagtcacagactgaccgagtgg acctggggaccctgcgcggctactacaaccagagcgaggacggttctcacaccatccagaggatgtatggctgcga cgtggggccggacgggcgcttcctccgcgggtaccagcaggacgcttacgacggcaaggattacatcTccctgaac gaggacctgcgctcttggaccgcggcggacatggcggctcagatcacccagcgcaagtgggagacggcccatgagg cggagcagtggagagcctacctggagggcacgtgcgtggagtggctccgcagatacctggagaacgggaaggagac gctgcagcgcacgg;

A*3601:

(SEQ ID NO: 208)

atggccgtcatggcgccccgaaccctcctcctgctactctcgggggccctggccctgacccagacctgggcgggct cccactccatgaggtatttcttcacatccgtgtcccggcccggccgcggggagccccgcttcatcgccgtgggcta cgtggacgacacgcagttcgtgcggttcgacagcgacgccgcgagccagaagatggagccgcgggcgccgtggata gagcaggaggggccggagtattgggaccaggagacacggaatatgaaggcccactcacagactgaccgagcgaacc tggggaccctgcgcggctactacaaccagagcgaggacggttctcacaccatccagataatgtatggctgcgacgt ggggccggacgggcgcttcctccgcgggtaccggcaggacgcctacgacggcaaggattacatcgccctgaacgag gacctgcgctcttggaccgcggcggacatggcagctcagatcaccaagcgcaagtgggaggcggtccatgcggcgg agcagcggagagtctacctggagggcaCgtgcgtggaGtggctccgcagatacctggagaacgggaaggagacgct gcagcgcacggaccccccaagacacatatgacccaccacccatctctgaccatgaggccaccctgaggtgctgg gccctgggcttctaccctgcggagatcacactgacctggcagcgggatggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatgggag;

A*3602:

(SEQ ID NO: 209)

gctcccactccatgaggtatttcttcacatccgtgtcccggcccggccgcggggagccccgcttcatcgccgtggg ctacgtggacgacacgcagttcgtgcggttcgacagcgacgccgcgagccagaagatggagccgcgggcgccgtgg atagagcaggaggggccggagtattgggaccaggagacacggaatatgaaggcccactcacagactgaccgagcga acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggtccatgcgg cggagcagcggagagcctacctggaTggcacgtgcgtggagtggctccgcagatacctggagaacgggaaggagac gctgcagcgcacgg;

A*3603:

(SEQ ID NO: 210)

atggccgtcatggcgccccgaaccctcctcctgctactctcgggggccctggccctgacccagacctgggcgggct cccactccatgaggtatttcttcacatccgtgtcccggcccggccgcggggagccccgcttcatcgccgtgggcta cgtggacgacacgcagttcgtgcggttcgacagcgacgccgcgagccagaagatggagccgcgggcgccgtggata gagcaggaggggccggagtattgggaccaggagacacggaatatgaaggcccactcacagactgaccgagcgaacc tggggaccctgcgcggctactacaaccagagcgaggacggttctcacaccCtccagatgatgtatggctgcgacgt ggggccggacgggcgcttcctccgcgggtaccggcaggacgcctacgacggcaaggattacatcgccctgaacgag -continued gacctgcgctcttggaccgcggcggacatggcagctcagatcaccaagcgcaagtgggaggcggtccatgcggcgg agcagcggagagtctacctggagggcaCgtgcgtggaGTggctccgcagatacctggagaacgggaaggagacgct gcagcgcacggaccccccaagacacatatgacccaccacccatctctgaccatgaggccaccctgaggtgctgg gccctgggcttctaccctgcggagatcacactgacctggcagcgggatggggaggaccagacccaggacacggagc tcgtggagaccaggcctgcaggggatggaaccttccagaagtgggcggctgtggtggtgccttctggagaggagca gagatacacctgccatgtgcagcatgagggtctgcccaagcccctcaccctgagatgggag;

A*3604:
(SEQ ID NO: 211)
gctcccactccatgaggtatttcttcacatccgtgtcccggcccggccgcggggagccccgcttcatcgccgtggg ctacgtggacgacacgcagttcgtgcggttcgacagcgacgccgcgagccagaagatggagccgcgggcgccgtgg atagagcaggaggggccggagtattgggaccaggagacacggaatatgaaggcccactcacagactgaccgagcga acctggggaccctgcgcggctactacaaccagagcgaggacggttctcacaccatccagataatgtatggctgcga cgtggggccggacgggcgcttcctccgcgggtaccggcaggacgcctacgacggcaaggattacatcgccctgaac gaggacctgcgctcttggaccgcggcggacatggcagctcagatcaccaagcgcaagtgggaggcggtccatgcgg cggagcagcggagagtctacctggagggccggtgcgtggaGtggctccgcagatacctggagaacgggaaggagac gctgcagcgcacgg;

A*4301:
(SEQ ID NO: 212)
atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccTgcagacacggaatgtgaaggcccactcacagactgaccgagcgaacc tggggaccctgcgcggctactacaaccagagcgaggacggttctcacaccatccagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagtggagagcctacctggagggccggtgcgtggagtggctccgcagatacctggagaacgggaaggagacgct gcagcgcacggacgccccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggGaccttccagaagtgggcgtctgtggtggtgccttctggaCaggagca gagatacacctgccatgtgcagcatgagggtctgcccaagcccctcaccctgagatgggag;

A*6601:
(SEQ ID NO: 213)
atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggccaGtcacagactgaccgagtgGacc tggggaccctgcgcggctactacaaccagagcgaggacggttctcacaccatccagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagTggagagcctacctggagggccggtgcgtggagtggctccgcagatacctggagaacgggaaggagacgct gcagcgcacggacgccccccaagacgcatatgactcaccacgctgtctctgaccatgaggccaccctgaggtgctgg gccctgagcttctaccctgcggagatcacactgacctggcagcgggatggggaggaccagacccaggacacggagc tcgtggagaccaggcctgcaggggatggGaccttccagaagtgggcgtctgtggtggtgccttctggacaggagca gagatacacctgccatgtgcagcatgagggtctgcccaagcccctcaccctgagatgggag;

A*6602:

(SEQ ID NO: 214)
atggccgtcatggcgccccgaaccctcgtcctgctactctcggggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccagtcacagactgaccgagtggacc tggggaccctgcgcggctactacaaccagagcgaggccggttctcacaccatccagaggatgtatggctgcgacgt ggggccggacgggcgcttcctccgcgggtaccagcaggacgcttacgacggcaaggattacatcgccctgaacgag gacctgcgctcttggaccgcggcggacatggcggctcagatcacccagcgcaagtgggagacggcccatgaggcgg agcagtggagagcctacctggagggcgAgtgcgtggagtggctccgcagatacctggagaacgggaaggagacgct gcagcgcacggacgcccccaagacgcatatgactcaccacgctgtctctgaccatgaggccaccctgagtgctgg gccctgagcttctaccctgcggagatcacactgacctggcagcgggatggggaggaccagacccaggacacggagc tcgtggagaccaggcctgcaggggatggaaccttccagaagtgggcgTctgtggtggtgccttctggaCaggagca gagatacacctgccatgtgcagcatgagggtctgcccaagcccctcaccctgagatgggag;

A*6603:

(SEQ ID NO: 215)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccactcacagactgaccgagtgg acctggggaccctgcgcggctactacaaccagagcgaggccggttctcacaccatccagaggatgtatggctgcga cgtggggccggacgggcgcttcctccgcgggtaccagcaggacgcttacgacggcaaggattacatcgccctgaac gaggacctgcgctcttggaccgcggcggacatggcggctcagatcacccagcgcaagtgggagacggcccatgAgg cggagcagtggagagcctacctggagggcgAgtgcgtggagTggctccgcagatacctggagaacgggaaggagac gctgcagcgcacgg;

A*6604:

(SEQ ID NO: 216)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccagtcacagactgaccgagtgg acctggggaccctgcgcggctactacaaccagagcgaggacggttctcacaccatccagaggatgtatggctgcga cgtggggccggacgggcgcttcctccgcgggtaccagcaggacgcttacgacggcaaggattacatcgccctgaac gaggacctgcgctcttggaccgcggcggacatggcggctcagatcacccagcgcaagtgggagacggcccatgAgg cggagcagtggagagcctacctggagggccggtgcgtggagtggctccgcagaCacctggagaacgggaaggagac gctgcagcgcacgg;

A*680101:

(SEQ ID NO: 217)
atggccgtcatggcgccccgaaccctcgtcctgctactctcggggggccctggccctgacccagacctgggcgggct cccactccatgaggtatttctacacCtccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccaGtcacagactgaccgagtggacc tggggaccctgcgcggctactacaaccagagcgaggccggttctcacaccatccagatgatgtatggctgcgacgt ggggTcggacgggcgcttcctccgcgggtaccggcaggacgcctacgacggcaaggattacatcgccctgaaagag gacctgcgctcttggaccgcggcggacatggcagctcagaccaccaagcacaagtgggaggcggccatgtggcgg agcagTggagagcctacctggagggcacgtgcgtggagtggctccgcagatacctggagaacgggaaggagacgct -continued gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggTggctgtggtggtgccttctggacaggagca gagatacacctgccatgtgcagcatgagggtTtgcccaagcccctcaccctgagatgggag;

A*680102:
(SEQ ID NO: 218)
atggccgtcatggcgccccgaaccctcgtcctgctactctcgggggccctggccctgacccagacctgggcgggct cccactccatgaggtatttctacacTtccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccaGtcacagactgaccgagtggacc tggggaccctgcgcggctactacaaccagagcgaggccggttctcacaccatccagatgatgtatggctgcgacgt ggggTcggacgggcgcttcctccgcgggtaccggcaggacgcctacgacggcaaggattacatcgccctgaaagag gacctgcgctcttggaccgcggcggacatggcagctcagaccaccaagcacaagtgggaggcggcccatgtggcgg agcagTggagagcctacctggagggcacgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggTggctgtggtggtgccttctggacaggagca gagatacacctgccatgtgcagcatgagggtTtgcccaagcccctcaccctgagatgggag;

A*6802:
(SEQ ID NO: 219)
atggccgtcatggcgccccgaaccctcgtcctgctactctcgggggccctggccctgacccagacctgggcgggct cccactccatgaggtatttctacacctccAtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccagtcacagactgaccgagtggacc tggggaccctgcgcggctactacaaccagagcgaggccggttctcacaccatccagaggatgtatggctgcgacgt ggggccggacgggcgcttcctccgcgggtaccaccagtacgcctacgacggcaaggattacatcgccctgaaagag gacctgcgctcttggaccgcggcggacatggcagctcagaccaccaagcacaagtgggaggcggcccatgtggcgg agcagtggagagcctacctggagggcacgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggtggctgtggtggtgccttctggacaggagca gagatacacctgccatgtgcagcatgagggtTtgcccaagcccctcaccctgagatgggag;

A*680301:
(SEQ ID NO: 220)
atggccgtcatggcgccccgaaccctcgtcctgctactctcgggggccctggccctgacccagacctgggcgggct cccactccatgaggtatttctacacTtccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccactcacagactgaccgagtggacc tggggaccctgcgcggctactacaaccagagcgaggccggttctcacaccatccagatgatgtatggctgcgacgt ggggTcggacgggcgcttcctccgcgggtaccggcaggacgcctacgacggcaaggattacatcgccctgaaagag gacctgcgctcttggaccgcggcggacatggcagctcagaccaccaagcacaagtgggaggcggcccatgtggcgg agcagTggagagcctacctggagggcacgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc -continued tcgtggagaccaggcctgcaggggatggaaccttccagaagtgggTggctgtggtggtgccttctggacaggagca gagatacacctgccatgtgcagcatgagggtTtgcccaagcccctcaccctgagatgggag;

A*680302:
(SEQ ID NO: 221)
gctctcactccatgaggtatttctacacTtccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccactcacagactgaccgagtgg acctggggaccctgcgcggctactacaaccagagcgaggccggttctcacaccatccagatgatgtatggctgcga cgtggggtcggacgggcgcttcctccgcgggtaccggcaggacgcctacgacggcaaggattacatcgccctgaaa gaggacctgcgctcttggaccgcggcggacatggcagctcagaCcaccaagcacaagtgggaggcggcccatgtgg cggagcagTggagagcctacctggagggcacgtgcgtggagtggctccgcagatacctggagaacgggaaggagac gctgcagcgcacgg;

A*6804:
(SEQ ID NO: 222)
gctcccactccatgaggtatttctacacctccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaaCacacggaatgtgaaggcccactcacagaTtgaccgagtgg acctggggaccctgcgcggctactacaaccagagcgaggccggttctcacaccatccagatgatgtatggctgcga cgtggggtcggacgggcgcttcctccgcgggtaccggcaggacgcctacgacggcaaggattacatcgccctgaaa gaggacctgcgctcttggaccgcggcggacatggcagctcagaccaccaagcAcaagtgggaggcggcccatgtgg cggagcagtggagagcctacctggagggcacgtgcgtggagTggctccgcagatacctggagaacgggaaggagac gctgcagcgcacgg;

A*6805:
(SEQ ID NO: 223)
gctcccactccatgaggtatttctacacTtccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccactcacagactCaccgagtgg acctggggaccctgcgcggctactacaaccagagcgaggccggttctcacaccatccagatgatgtatggctgcga cgtggggtcggacgggcgcttcctccgcgggtaccggcaggacgcctacgacggcaaggattacatcgccctgaaa gaggacctgcgctcttggaccgcggcggacatggcagctcagaCcaccaagcacaagtgggaggcggcccatgtgg cggagcagTggagagcctacctggagggcacgtgcgtggagtggctccgcagatacctggagaacgggaaggagac gctgcagcgcacgg;

A*6806:
(SEQ ID NO: 224)
gctcccactccatgaggtatttctacacttccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccaGtcacagactgaccgagtgg acctggggaccctgcgcggctactacaaccagagcgaggccggttctcacaccatccagatgatgtatggctgcga cgtggggtcggacgggcgcttcctccgcgggtatgaAcagcacgcctacgacggcaaggattacatcgccctgaaa gaggacctgcgctcttggaccgcggcggacatggcagctcagaccaccaagcAcaagtgggaggcggcccatgTgg cggagcagtggagagcctacctggagggcacgtgcgtggagtggctccgcagatacctggagaacgggaaggagac gctgcagcgcacgg;

A*6807:

(SEQ ID NO: 225)

gctcccactccatgaggtatttctacacttccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccaGtcacagactgaccgagtgg acctggggaccctgcgcggctactacaaccagagcgaggccggttctcacaccatccagatgatgtatggctgcga cgtggggtcggacgggcgcttcctccgcgggtaccggcagCacgcctacgacggcaaggattacatcgccctgaaa gaggacctgcgctcttggaccgcggcggacatggcagctcagaccaccaagcAcaagtgggaggcggcccatgTgg cggagcagtggagagcctacctggagggcacgtgcgtggagtggctccgcagatacctggagaacgggaaggagac gctgcagcgcacgg;

A*6808:

(SEQ ID NO: 226)

atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccagtcacagactgaccgagtggacc tggggaccctgcgcggctactacaaccagagcgaggccggttctcacaccatccagatgatgtatggctgcgacgt ggggtcggacgggcgcttcctccgcgggtaccggcaggacgcctacgacggcaaggattacatcgccctgaaagag gacctgcgctcttggaccgcggcggacatggcagctcagaccaccaagcacaagtgggaggcggcccatgtggcgg agcagcTgagagcctacctggagggcacgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggTggctgtggtggtgccttctggacaggagca gagatacacctgccatgtgcagcatgagggtTtgcccaagcccctcaccctgagatgggag;

A*6809:

(SEQ ID NO: 227)

gctcccactccatgaggtatttctacacTtccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccagtcacagactgaccgagtgg acctggggaccctgcgcggctactacaaccagagcgaggccggttctcacaccatccagatgatgtatggctgcga cgtggggtcggacgggcgcttcctccgcgggtaccggcaggacgcctacgacggcaaggattacatcgccctgaaa gaggacctgcgctcttggaccgcggcggacatggcagctcagaccaccaagcacaagtgggaggcggcccatgtgg cggagcagcAgagagcctacctggagggcacgtgcgtggagtggctccgcagatacctggagaacgggaaggagac gctgcagcgcacgg;

A*6810:

(SEQ ID NO: 228)

gctcccactccatgaggtatttctacacCtccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacGaggagacacggaatgtgaaggcccaGtcacagactgaccgagtgg acctggggaccctgcgcggctactacaaccagagcgaggccggttctcacaccatccagatgatgtatggctgcga cgtggggTcggacgggcgcttcctccgcgggtaccggcaggacgcctacgacggcaaggattacatcgccctgaaa gaggacctgcgctcttggaccgcggcggacatggcagctcagaccaccaagcacaagtgggaggcggcccatgTgg cggagcagTggagagcctacctggagggcaCgtgcgtggagTggctccgcagatacctggagaacgggaaggagac gctgcagcgcacgg;

-continued

A*6812:

(SEQ ID NO: 229)

accctcgtcctgctactctcgggggccctggccctgacccagacctgggcgggctcccactccatgaggtatttct acacTtccgtgtcccggcccggccgcggggagccccgcttcatcgccgtgggctacgtggacgacacgcagttcgt gcggttcgacagcgacgccgcgagccagaggatggagccgcgggcgccgtggatagagcaggaggggccggagtat tgggaccggaacacacggaatgtgaaggcccaGtcacagactgaccgagtggacctggggaccctgcgcggctact acaaccagagcgaggccggttctcacaccatccagatgatgtatggctgcgacgtggggtcggacgggcgcttcct ccgcgggtaccggcaggacgcctacgacggcaaggattacatcgccctgaaagaggacctgcgctcttggaccgcg gcggacatggcagctcagatcaccaagcacaagtgggaggcggcccatgtggcggagcagTggagagcctacctgg agggcacgtgcgtggagtggctccgcagatacctggagaacgggaag;

A*6813:

(SEQ ID NO: 230)

atggccgtcatggcgccccgaaccctcgtcctgctactctcgggggccctggccctgacccagacctgggcgggct cccactccatgaggtatttctacacCtccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggagacacggaatgtgaaggcccaGtcacagactgaccgagtggacc tggggaccctgcgcggctactacaaccagagcgaggccggttctcacaccatccagatgatgtatggctgcgacgt ggggTcggacgggcgcttcctccgcgggtaccggcaggacgcctacgacggcaaggattacatcgccctgaaagag gacctgcgctcttggaccgcggcggacatggcagctcagaccaccaagcacaagtgggaggcggcccatgtggcgg agcagTggagagcctacctggagggcacgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggTggctgtggtggtgccttctggacaggagca gagatacacctgccatgtgcagcatgaggg;

A*6814:

(SEQ ID NO: 231)

gctcccactccatgaggtatttctacacCtccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggacGaggagacacggaatgtgaaggcccaGtcacagactgaccgagtgg acctggggaccctgcgcggctactacaaccagagcgaggccggttctcacaccatccagatgatgtatggctgcga cgtggggTcggacgggcgcttcctccgcgggtaccggcaggacgcctacgacggcaaggattacatcgccctgaaa gaggacctgcgctcttggaccgcggcggacatggcagctcagaccaccaagcacaagtgggaggcggcccatgTgg cggagcagTggagagcctacctggagggcaCgtgcgtggagTggctccgcagatacctggagaacgggaaggagac gctgcagcgcgcgg;

A*6815:

(SEQ ID NO: 232)

gctcccactccatgaggtatttctacacctccAtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaaCacacggaatgtgaaggcccactcacagactCaccgagtgg acctggggaccctgcgcggctactacaaccagagcgaggccggttctcacaccatccagaggatgtatggctgcga cgtggggccggacgggcgcttcctccgcgggtaccaccagtacgcctacgacggcaaggattacatcgccctgaaa gaggacctgcgctcttggaccgcggcggacatggcagctcagaccaccaagcacaagtgggaggcggcccatgtgg cggagcagtggagagcctacctggagggcacgtgcgtggagtggctccgcagatacctggagaacgggaaggagac gctgcagcgcacgg;

A*6816:

(SEQ ID NO: 233)
ccgtcatggcgccccgaaccctcgtcctgctactctcgggggccctggccctgacccagacctgggcgggctccca ctccatgaggtatttctacacttccgtgtcccggcccggccgcggggagccccgcttcatcgccgtgggctacgtg gacgacacgcagttcgtgcggttcgacagcgacgccgcgagccagaggatggagccgcgggcgccgtggatagagc aggaggggccggagtattgggaccggaacacacggaatgtgaaggcccagtcacagactgaccgagtggacctggg gaccctgcgcggctactacaaccagagcgaggccggttctcacaccatccagatgatgtatggctgcgacgtgggg tcggacgggcgcttcctccgcgggtaccggcaggacgcctacgacggcaaggattacatcgccctgaaagaggacc tgcgctcttggaccgcggcggacatggcagctcagaccaccaagcacaagtgggaggcggcccTtgtggcggagca gtggagagcctacctggagggcacgtgcgtggagtggctccgcagatacctggagaacgggaaggagacgctgcag cgcacgg;

A*6817:

(SEQ ID NO: 234)
atggccgtcatggcgccccgaaccctcgtcctgctactctcgggggccctggccctgacccagacctgggcgggct cccactccatgaggtatttctacacttccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccagtcacagactgaccgagtggacc tggggaccctgcgcggctactacaaccagagcgaggccggttctcacaccatccagatgatgtatggctgcgacgt ggggtcggacgggcgcttcctccgcgggtaccggcaggTcgcctacgacggcaaggattacatcgccctgaaagag gacctgcgctcttggaccgcggcggacatggcagctcagaccaccaagcacaagtgggaggcggcccatgtggcgg agcagtggagagcctacctggagggcacgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggtggctgtggtggtgccttctggacaggagca gagatacacctgccatgtgcagcatgagggtTtgcccaagcccctcaccctgagatgggag;

A*6819:

(SEQ ID NO: 235)
gctcccactccatgaggtatttctacacttccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccagtcacagactgaccgagtgg acctggggaccctgcgcggctactacaaccagagcgaggccggttctcacaccatccagatgatgtatggctgcga cgtggggtcggacgggcgcttcctccgcgggtaccggcaggacgcctacgacggcaaggattacatcgccctgaaa gaggacctgcgctcttggaccgcggcggacatggcagctcagaccaccaagcAcaagtgggaggcggcccatgTgg cggagcagTggagagcctacctggaTggcacgtgcgtggagtggctccgcagatacctggagaacgggaaggagac gctgcagcgcacgg;

A*6820:

(SEQ ID NO: 236)
gctcccactccatgaggtatttctacacttccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccactcacagactcaccgagtgg acctggggaccctgcgcggctactacaaccagagcgaggccggttctcacaccatccagatgatgtatggctgcga cgtggggtcggacgggActtcctccgcgggtaccggcaggacgcctacgacggcaaggattacatcgccctgaaa gaggacctgcgctcttggaccgcggcggacatggcagctcagaccaccaagcacaagtgggaggcggcccatgtgg -continued cggagcagtggagagcctacctggagggcacgtgcgtggagtggctccgcagatacctggagaacgggaaggagac gctgcagcgcacgg;

A*6821:

(SEQ ID NO: 237)

gctcccactccatgaggtatttctacacttccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccagtcacagactgaccgagtgg acctggggaccctgcgcggctactacaaccagagcgaggccggttctcacaccatccagatgatgtatggctgcga cgtggggtcggacgggcgcttcctccgcgggtaccggcaggacgcctacgacggcaaggattacatcgccctgaaa gaggacctgcgctcttggaccgcggcggacatggcagctcagaccaccaagcacaagtgggaggcggcccatgTgg cggagcagtggagagcctacctggagggcacgtgcgtggagtggctccgcagatacctggagaacCggaaggagac gctgcagcgcacgg;

A*6822:

(SEQ ID NO: 238)

atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaacacacggaatgtgaaggcccagtcacagactgaccgagtggacc tggggaccctgcAcggctactacaaccagagcgaggccggttctcacaccatccagatgatgtatggctgcgacgt ggggtcggacgggcgcttcctccgcgggtaccggcaggacgcctacgacggcaaggattacatcgccctgaaagag gacctgcgctcttggaccgcggcggacatggcagctcagaccaccaagcacaagtgggaggcggcccatgtggcgg agcagtggagagcctacctggagggcacgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggtggctgtggtggtgccttctggacaggagca gagatacacctgccatgtgcagcatgagggtttgcccaagcccctcaccctgagatgggag;

A*6823:

(SEQ ID NO: 239)

gctcccactccatgaggtatttctacacTtccgtgtcccggcccggccgcggggagccccgcttcatcgccgtggg ctacgtggacgacacgcagttcgtgcggttcgacagcgacgccgcgagccagaggatggagccgcgggcgccgtgg atagagcaggaggggccggagtattgggaccggaacacacggaatgtgaaggcccagtcacagactgaccgagtgg acctggggaccctgcgcggctactacaaccagagcgaggccggttctcacaccatccagaGgatgtatggctgcga cgtggggtcggacgggcgcttcctccgcgggtaccggcaggacgcctacgacggcaaggattacatcgccctgaaa gaggacctgcgctcttggaccgcggcggacatggcagctcagaCcaccaagcacaagtgggaggcggcccatgtgg cggagcagTggagagcctacctggagggcacgtgcgtggagtggctccgcagatacctggagaacgggaaggagac gctgcagcgcacgg;

A*6901:

(SEQ ID NO: 240)

atggccgtcatggcgccccgaaccctcgtcctgctactctcgggggccctggccctgacccagacctgggcgggct cccactccatgaggtatttctacacctccgtgtcccggcccggccgcggggagccccgcttcatcgccgtgggcta cgtggacgacacgcagttcgtgcggttcgacagcgacgccgcgagccagaggatggagccgcgggcgccgtggata gagcaggaggggccggagtattgggaccggaaCacacggaatgtgaaggcccaGtcacagactgaccgagtggacc tggggaccctgcgcggctactacaaccagagcgaggccggttctcacaccGtccagaGgatgtatggctgcgacgt ggggtcggacTggcgcttcctccgcgggtaccaccagtacgcctacgacggcaaggattacatcgccctgaaagag -continued gacctgcgctcttggaccgcggcggacatggcagctcagaccaccaagcacaagtgggaggcggcccatgTggcgg agcagTTgagagcctacctggagggcaCgtgcgtggagtggctccgcagatacctggagaacgggaaggagacgct gcagcgcacggacgcccccaaaacgcatatgactcaccacgctgtctctgaccatgaagccaccctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtgccttctggacaggagca gagatacacctgccatgtgcagcatgagggtTtgcccaagcccctcaccctgagatgggag;

A*7401:
(SEQ ID NO: 241)
atggccgtcatggcgccccgaaccctcctcctgctactcttgggggccctggccctgacccagaccAgggcgggct cccactccatgaggtatttcttcacatccgtgtcccggcccggccgcggggagccccgcttcatcgccgtgggcta cgtggacgacacgcagttcgtgcggtttgacagcgacgccgcgagccagaggatggagccgcgggcgccgtggata gagcaggaggggccggagtattgggaccaggagacacggaatgtgaaggcccactcacagactgaccgagtggacc tggggaccctgcgcggctactacaaccagagcgaggccggttctcacaccatccagatgatgtatggctgcgacgt ggggccggacgggcgcctcctccgcgggtaccagcaggacgcctacgacggcaaggattacatcgccttgaacgag gacctgcgctcttggaccgcggcggacatggcggctcagatcacccagcgcaagtgggaggcggcccgtgtggcgg agcagttgagagcctacctggagggcacgtgcgtggagtggctccgcagatacctggagaacgggaaggagacgct gcagcgcacggacgcccccaagacgcatatgactcaccacgctgtctctgaccatgaggccaccctgaggtgctgg gccctgagcttctaccctgcggagatcacactgacctggcagcgggatggggaggaccagacccaggacacggagc ttgtggagaccaggcctgcaggggatggaaccttccagaagtgggcgtctgtggtggtgccttctggaCaggagca gagatacacctgccatgtgcagcatgagggtctgcccaagcccctcaccctgagatgggag;

A*7402:
(SEQ ID NO: 242)
atggccgtcatggcgccccgaaccctcctcctgctactctTgggggccctggccctgacccagacctgggcgggct cccactccatgaggtatttcttcacatccgtgtcccggcccggccgcggggagccccgcttcatcgccgtgggcta cgtggacgacacgcagttcgtgcggtttgacagcgacgccgcgagccagaggatggagccgcgggcgccgtggata gagcaggaggggccggagtattgggaccaggagacacggaatgtgaaggcccactcacagactgaccgagtgGacc tggggaccctgcgcggctactacaaccagagcgaggccggttctcacaccatccagatgatgtatggctgcgacgt ggggccggacgggcgcCtcctccgcgggtaccAgcaggacgcctacgacggcaaggattacatcgccTtgaacgag gacctgcgctcttggaccgcggcggacatggcggctcagatcacccagcgcaagtgggaggcggcccgtgtggcgg agcagtTgagagcctacctggagggcacgtgcgtggagTggctccgcagatacctggagaacgggaaggagacgct gcagcgcacgg;

A*7403:
(SEQ ID NO: 243)
atggccgtcatggcgccccgaaccctcctcctgctactcttgggggccctggccctgacccagaccagggcgggct cccactccatgaggtatttcttcacatccgtgtcccggcccggccgcggggagccccgcttcatcgccgtgggcta cgtggacgacacgcagttcgtgcggtttgacagcgacgccgcgagccagaggatggagccgcgggcgccgtggata gagcaggaggggccggagtattgggaccaggagacacggaatgtgaaggcccactcacagactgaccgagtggacc tggCgaccctgcgcggctactacaaccagagcgaggccggttctcacaccatccagatgatgtatggctgcgacgt ggggccggacgggcgcctcctccgcgggtaccagcaggacgcctacgacggcaaggattacatcgccttgaacgag gacctgcgctcttggaccgcggcggacatggcggctcagatcacccagcgcaagtgggaggcggcccgtgtggcgg agcagttgagagcctacctggagggcacgtgcgtggagtggctccgcagatacctggagaacgggaaggagacgct gcagcgcacgg;

A*7404:
(SEQ ID NO: 244)
ggctcccactccatgaggtatttcttcacatccgtgtcccggcccggccgcggggagccccgcttcatcgccgtggg gctacgtggacgacacgcagttcgtgcggtttgacagcgacgccgcgagccagaggatggagccgcgggcgccgtg gatagagcaggaggggtccggagtattgggacggggagacacggaaAgtgaaggcccactcacagactgaccgagtg Gacctggggaccctgcgcggctactacaaccagagcgaggccggttctcacaccatccagatgatgtatggctgcg acgtggggccggacgggcgCtcctccgcgggtaccagcaggacgcctacgacggcaaggattacatcgccttgaa cgaggacctgcgctcttggaccgcggcggacatggcggctcagatcacccagcgcaagtgggaggcggcccGtgtg gcggagcagtTgagagcctacctggagggcacgtgcgtggagtggctccgcagatacctggagaacgggaaggaga cgctgcagcgcacgg;

A*7405:
(SEQ ID NO: 245)
gctcccactccatgaggtatttcttcacatccgtgtcccggcccggccgcggggagccccgcttcatcgccgtggg ctacgtggacgacacgcagttcgtgcggtttgacagcgacgccgcgagccagaggatggagccgcgggcgccgtgg atagagcaggaggggccggagtattgggaccaggagacacggaatgtgaaggcccactcacagGctgaccgagtgg acctggggaccctgcgcggctactacaaccagagcgaggccggttctcacaccatccagatgatgtatggctgcga cgtggggccggacgggcgcctcctccgcgggtaccagcaggacgcctacgacggcaaggattacatcgccttgaac gaggacctgcgctcttggaccgcggcggacatggcggctcagatcacccagcgcaagtgggaggcggcccgtgtgg cggagcagttgagagcctacctggagggcacgtgcgtggagtggctccgcagatacctggagaacgggaaggagac gctgcagcgcacgg;

A*7406:
(SEQ ID NO: 246)
gctcccactccatgaggtatttcttcacatccgtgtcccggcccggccgcggggagccccgcttcatcgccgtggg ctacgtggacgacacgcagttcgtgcggtttgacagcgacgccgcgagccagaggatggagccgcgggcgccgtgg atagagcaggaggggccggagtattgggaccaggagacacggaatgtgaaggcccactcacagactCaccgagtgG acctggggaccctgcgcggctactacaaccagagcgaggccggttctcacaccatccagatgatgtatggctgcga cgtggggccggacgggcgCtcctccgcgggtaccagcaggacgcctacgacggcaaggattacatcgccttgaac gaggacctgcgctcttggaccgcggcggacatggcggctcagatcacccagcgcaagtgggaggcggcccGtgtgg cggagcagtTgagagcctacctggagggcacgtgcgtggagtggctccgcagatacctggagaacgggaaggagac gctgcagcgcacg;

A*7407:
(SEQ ID NO: 247)
gctcccactccatgaggtatttcttcacatccgtgtcccggcccggccgcggggagccccgcttcatcgccgtggg ctacgtggacgacacgcagttcgtgcggtttgacagcgacgccgcgagccagaggatggagccgcgggcgccgtgg atagagcaggaggggccggagtattgggaccaggagacacggaatgtgaaggcccactcacagaTtgaccgagtgG acctggggaccctgcgcggctactacaaccagagcgaggccggttctcacaccatccagatgatgtatggctgcga cgtggggccggacgggcgCtcctccgcgggtaccagcaggacgcctacgacggcaaggattacatcgccttgaac gaggacctgcgctcttggaccgcggcggacatggcggctcagatcacccagcgcaagtgggaggcggcccGtgtgg cggagcagtTgagagcctacctggagggcacgtgcgtggagtggctccgcagatacctggagaacgggaaggagac gctgcagcgcacgg;

A*7408:
(SEQ ID NO: 248)
gctcccactccatgaggtatttcttcacatccgtgtcccggcccggccgcggggagccccgcttcatcgccgtggg ctacgtggacgacacgcagttcgtgcggtttgacagcgacgccgcgagccagaggatggagccgcgggcgccgtgg atagagcaggaggggccggagtattgggaccaggagacacggaatgtgaaggcccactcacagactgaccgagtgg -continued

```
acctggggaccctgcgcggctactacaaccagagcgaggccggttctcacaccatccagatgatgtatggctgcga cgtggggccggacgggcgcctcctccgcgggtaccagcaggacgcctacgacggcaaggattacatcgccttgaac gaggacctgcgctcttggaccgcggcggacatggcggctcagatcacccagcgcaagtgggaggcggccAgtgtgg cggagcagttgagagcctacctggagggcacgtgcgtggagtggctccgcagatacctggagaacgggaaggagac gctgcagcgcacgg;
```

A*7409: (SEQ ID NO: 249)

```
gctcccactccatgaggtatttcttcacatccgtgtcccCgcccggccgcggggagccccgcttcatcgccgtggg ctacgtggacgacacgcagttcgtgcggtttgacagcgacgccgcgagccagaggatggagccgcgggcgccgtgg atagagcaggaggggccggagtattgggaccaggagacacggaatgtgaaggcccactcacagactgaccgagtgg acctggggaccctgcgcggctactacaaccagagcgaggccggttctcacaccatccagatgatgtatggctgcga cgtggggccggacgggcgcctcctccgcgggtaccagcaggacgcctacgacggcaaggattacatcgccttgaac gaggacctgcgctcttggaccgcggcggacatggcggctcagatcacccagcgcaagtgggaggcggcccgtgtgg cggagcagttgagagcctacctggagggcacgtgcgtggagtggctccgcagatacctggagaacgggaaggagac gctgcagcgcacgg;
```

A*8001: (SEQ ID NO: 250)

```
Atggccgtcatgccgcccccgaaccctcctcctgctactctcgggggccctggccctgacccagacctgggcaggct cccactccatgaggtatttcttcacatccgtgtcccggcccggccgcggggagccccgcttcatcgcagtgggcta cgtggacgactcgcagttcgtgcagttcgacagcgacgccgcgagccagaggatggagccgcgggcgccgtggata gagcaggaggagccggagtattgggacgaggagacacggaatgtgaaggcccactcacagactaaccgagcgaacc tggggaccctgcgcggctactacaaccagagcgaggacggttctcacaccatccagataatgtatggctgcgacgt ggggtcggacgggcgcttcctccgcgggtaccggcaggacgcctacgacggcaaggattacatcgccctgaacgag gacctgcgctcttggaccgcggcggacatggcggctcagatcaccaagcgcaagtgggaggcggcccgtcgggcgg agcagctgagagcctacctggaggcgagtgcgtggacgggctccgcagatacctggagaacgggaaggagacgct gcagcgcacggaccccccaagacacatatgacccaccacccatctctgaccatgaggccactctgaggtgctgg gccctgagcttctaccctgcggagatcacactgacctggcagcgggatggggaggaccagacccaggacacggagc tcgtggagaccaggcctgcaggggatggaaccttccagaagtgggcggctgtggtggtaccttctggaaaggagaa gagatacacctgccatgtgcagcatgagggtctgcccGagcccctcaccctgagatgggag;
```

The probe list A1 is shown in Tables 1-1 to 1-7 and the probe list A2 is shown in Tables 2-1 to 2-6. The allele-probe lists are shown in Tables 3-1 to 3-9 and Tables 4-1 to 4-9.

TABLE 1-1

| Probe No. | Base Sequence | |
|---|---|---|
| 0 | g ccc cgc ttc atc gcC | (SEQ ID No: 251) |
| 1 | gac cag gag aca cgg aat A | (SEQ ID No: 252) |
| 2 | gcg gag cag cgg aga gT | (SEQ ID No: 253) |
| 3 | a gtc tac ctg gag ggc C | (SEQ ID No: 254) |
| 4 | gtc tac ctg gag ggc cG | (SEQ ID No: 255) |
| 5 | agg tgc tgg gcc ctg G | (SEQ ID No: 256) |
| 6 | g gtg gtg cct tct gga G | (SEQ ID No: 257) |
| 7 | c acc ctg aga tgg gag cT | (SEQ ID No: 258) |
| 8 | cc ctg aga tgg gag ctG | (SEQ ID No: 259) |
| 9 | g gac atg gca gct cag atT | (SEQ ID No: 260) |
| 10 | cac tcc atg agg tat ttc tC | (SEQ ID No: 261) |
| 11 | c cgg ccc ggc agt ggA | (SEQ ID No: 262) |
| 12 | t tct cac acc atc cag atG | (SEQ ID No: 263) |
| 13 | c cat gcg gcg gag cag T | (SEQ ID No: 264) |
| 14 | cat gcg gcg gag cag tT | (SEQ ID No: 265) |
| 15 | ata gag cag gag agg ccT | (SEQ ID No: 266) |
| 16 | c tca cag act gac cga gA | (SEQ ID No: 267) |
| 17 | c tac aac cag agc gag gC | (SEQ ID No: 268) |

TABLE 1-1-continued

| Probe No. | Base Sequence | |
|---|---|---|
| 18 | ga gtc tac ctg gag ggc T | (SEQ ID No: 269) |
| 19 | gtg gac gac acg cag ttA | (SEQ ID No: 270) |
| 20 | tg cta ctc tcg ggg gcT | (SEQ ID No: 271) |
| 21 | g gcc cac tca cag act C | (SEQ ID No: 272) |
| 22 | g gcc ggt tct cac acc G | (SEQ ID No: 273) |
| 23 | t tct cac acc gtc cag aG | (SEQ ID No: 274) |
| 24 | c gac gtg ggg tcg gac T | (SEQ ID No: 275) |
| 25 | gg gag gcg gcc cat gT | (SEQ ID No: 276) |
| 26 | c cat gtg gcg gag cag tT | (SEQ ID No: 277) |
| 27 | gcc tac ctg gag ggc aC | (SEQ ID No: 278) |
| 28 | ga gct gtg gtc gct gcT | (SEQ ID No: 279) |
| 29 | ag ccc cgc ttc atc gcA | (SEQ ID No: 280) |
| 30 | ccg gag tat tgg gac gG | (SEQ ID No: 281) |

TABLE 1-2

| Probe No. | Base Sequence | |
|---|---|---|
| 31 | gacggggaga cacggaaA | (SEQ ID No: 282) |
| 32 | cctccgcggg taccaC | (SEQ ID No: 283) |
| 33 | ccgcgggtac caccagT | (SEQ ID No: 284) |
| 34 | ggattacatc gccctgaaA | (SEQ ID No: 285) |
| 35 | ggacatggca gctcagaC | (SEQ ID No: 286) |
| 36 | gggcacgtgc gtggagT | (SEQ ID No: 287) |
| 37 | gcccactcac agactcaT | (SEQ ID No: 288) |
| 38 | tgcgctcttg gaccgcA | (SEQ ID No: 289) |
| 39 | attacatcgc cctgaaagaA | (SEQ ID No: 290) |
| 40 | ggggtcggac tggcgA | (SEQ ID No: 291) |
| 41 | tcccggcccg gccgT | (SEQ ID No: 292) |
| 42 | catgtgcagc atgagggtT | (SEQ ID No: 293) |
| 43 | gaccagaccc aggacacA | (SEQ ID No: 294) |
| 44 | ccatgtggcg gagcagT | (SEQ ID No: 295) |
| 45 | cggactggcc cttcctG | (SEQ ID No: 296) |
| 46 | ccaagcacaa gtgggagA | (SEQ ID No: 297) |
| 47 | tgggagacgg cccatgA | (SEQ ID No: 298) |
| 48 | ccatgaggcg gagcagT | (SEQ ID No: 299) |
| 49 | ccatgaggta tttctacacC | (SEQ ID No: 300) |
| 50 | caccgtccag aggatgtG | (SEQ ID No: 301) |
| 51 | gtggagacca ggcctgA | (SEQ ID No: 302) |
| 52 | caccgtccag aggatgtT | (SEQ ID No: 303) |

TABLE 1-2-continued

| Probe No. | Base Sequence | |
|---|---|---|
| 53 | gaaggcccac tcacagaT | (SEQ ID No: 304) |
| 54 | catgtggcgg agcagcA | (SEQ ID No: 305) |
| 55 | gggaggcggc ccatgA | (SEQ ID No: 306) |
| 56 | catgaggcgg agcagcA | (SEQ ID No: 307) |
| 57 | gcctacctgg agggcgA | (SEQ ID No: 308) |
| 58 | acaccctcca gatgatgtT | (SEQ ID No: 309) |
| 59 | gaggtgctgg gccctgA | (SEQ ID No: 310) |
| 60 | ggaccgcggc ggacaA | (SEQ ID No: 311) |

TABLE 1-3

| Probe No. | Base Sequence | |
|---|---|---|
| 61 | ca cag act cac cga gtg G | (SEQ ID No: 312) |
| 62 | c gcg gcg gac atg gcG | (SEQ ID No: 313) |
| 63 | gt ccg gag tat tgg gac G | (SEQ ID No: 314) |
| 64 | ac ggg gag aca cgg aaC | (SEQ ID No: 315) |
| 65 | ca gtg ggc tac gtg gac A | (SEQ ID No: 316) |
| 66 | tgg gag acg gcc cat gT | (SEQ ID No: 317) |
| 67 | c cat gag gcg gag cag tT | (SEQ ID No: 318) |
| 68 | a gct cag acc acc aag cA | (SEQ ID No: 319) |
| 69 | cat gcg gcg gag cag cA | (SEQ ID No: 320) |
| 70 | cg tgg ata gag cag gag A | (SEQ ID No: 321) |
| 71 | gac ggg gag aca cgg C | (SEQ ID No: 322) |
| 72 | c tgg gcg ggc tct caG | (SEQ ID No: 323) |
| 73 | tc gac agc gac gcc gG | (SEQ ID No: 324) |
| 74 | c acc gtc cag agg atg tC | (SEQ ID No: 325) |
| 75 | cgg aaa gtg aag gcc caG | (SEQ ID No: 326) |
| 76 | g gcc cag tca cag act C | (SEQ ID No: 327) |
| 77 | g gct cag atc acc aag cA | (SEQ ID No: 328) |
| 78 | gcg gag cag ttg aga gC | (SEQ ID No: 329) |
| 79 | g ggc acg tgc gtg gaG | (SEQ ID No: 330) |
| 80 | g tgg gag gcg gcc cG | (SEQ ID No: 331) |
| 81 | gg gag gcg gcc cgt gT | (SEQ ID No: 332) |
| 82 | c cgc ggg tac cag cag T | (SEQ ID No: 333) |
| 83 | g gag ccc cgc ttc atc T | (SEQ ID No: 334) |
| 84 | gac cag gag aca cgg aaA | (SEQ ID No: 335) |
| 85 | at tgg gac gag gag aca G | (SEQ ID No: 336) |
| 86 | gac gag gag aca ggg aaA | (SEQ ID No: 337) |

TABLE 1-3-continued

| Probe No. | Base Sequence | |
|---|---|---|
| 87 | g aag gcc cac tca cag aG | (SEQ ID No: 338) |
| 88 | g agg tat ttc ttc aca tcc A | (SEQ ID No: 339) |
| 89 | ttc ctc cgc ggg tat gaA | (SEQ ID No: 340) |
| 90 | gag tat tgg gac cgg aaC | (SEQ ID No: 341) |

TABLE 1-4

| Probe No. | Base Sequence | |
|---|---|---|
| 91 | cgg aat gtg aag gcc caG | (SEQ ID No: 342) |
| 92 | g gcc ggt tct cac acc C | (SEQ ID No: 343) |
| 93 | t tct cac acc ctc cag aG | (SEQ ID No: 344) |
| 94 | c cgg ccc ggc cgc gA | (SEQ ID No: 345) |
| 95 | cgc ggg tac cac cag tT | (SEQ ID No: 346) |
| 96 | ca cag act gac cga gtg G | (SEQ ID No: 347) |
| 97 | g ttg aga gcc tac ctg gaT | (SEQ ID No: 348) |
| 98 | cat gag gcg gag cag cT | (SEQ ID No: 349) |
| 99 | ctg aga gcc tac ctg gaT | (SEQ ID No: 350) |
| 100 | tgg ata gag cag gag ggT | (SEQ ID No: 351) |
| 101 | cag aga gcc tac ctg gaT | (SEQ ID No: 352) |
| 102 | ggc ctg gtt ctc ctt gC | (SEQ ID No: 353) |
| 103 | g aga gcc tac ctg gat gC | (SEQ ID No: 354) |
| 104 | ggc tgc gac gtg ggg T | (SEQ ID No: 355) |
| 105 | g ggc cgg tgc gtg gaG | (SEQ ID No: 356) |
| 106 | ggc cgg tgc gtg gag T | (SEQ ID No: 357) |
| 107 | gc tct tgg acc gcg gcA | (SEQ ID No: 358) |
| 108 | gg ccc ggc cgc ggg A | (SEQ ID No: 359) |
| 109 | gg gag gcg gcc cgt gA | (SEQ ID No: 360) |
| 110 | cgt gag gcg gag cag cA | (SEQ ID No: 361) |
| 111 | g gca gct cag atc acc G | (SEQ ID No: 362) |
| 112 | g ccg gac ggg cgc ttA | (SEQ ID No: 363) |
| 113 | g cag aga gcc tac ctg C | (SEQ ID No: 364) |
| 114 | g ccg gag tat tgg gac cT | (SEQ ID No: 365) |
| 115 | g gca gct cag atc acc aG | (SEQ ID No: 366) |
| 116 | g gag gcg gcc cgt cG | (SEQ ID No: 367) |
| 117 | ac gag gag aca ggg aaa G | (SEQ ID No: 368) |
| 118 | cc cag ccc acc gtc cA | (SEQ ID No: 369) |
| 119 | c cgt gtg gcg gag cag T | (SEQ ID No: 370) |
| 120 | gcg gag cag tgg aga gC | (SEQ ID No: 371) |

TABLE 1-5

| Probe No. | Base Sequence | |
|---|---|---|
| 121 | ggc aag gat tac atc gcc T | (SEQ ID No: 372) |
| 122 | cgt gtg gcg gag cag tT | (SEQ ID No: 373) |
| 123 | c tcc cac tcc atg agg tG | (SEQ ID No: 374) |
| 124 | cg ctc cgc tac tac aac G | (SEQ ID No: 375) |
| 125 | ctg cgg atc gcg ctc C | (SEQ ID No: 376) |
| 126 | gcg gag cag cag aga gC | (SEQ ID No: 377) |
| 127 | a tct tcc cag ccc acc G | (SEQ ID No: 378) |
| 128 | ctg ggc ttc tac cct gcA | (SEQ ID No: 379) |
| 129 | cgc ggg tac cac cag taT | (SEQ ID No: 380) |
| 130 | ag acg ctg cag cgc acT | (SEQ ID No: 381) |
| 131 | g gcg gct cag atc acc C | (SEQ ID No: 382) |
| 132 | ggg aaa gtg aag gcc caG | (SEQ ID No: 383) |
| 133 | cc tgg gca ggc tcc caA | (SEQ ID No: 384) |
| 134 | g ggc acg tgc gtg gac T | (SEQ ID No: 385) |
| 135 | gac ggg cgc ttc ctc cA | (SEQ ID No: 386) |
| 136 | gg acc gcg gcg gac aG | (SEQ ID No: 387) |
| 137 | cg gag tat tgg gac gag C | (SEQ ID No: 388) |
| 138 | a cag act gac cga gag aG | (SEQ ID No: 389) |
| 139 | c cag agg atg gag ccg T | (SEQ ID No: 390) |
| 140 | g agc cag agg atg gag cT | (SEQ ID No: 391) |
| 141 | gc tcc cac tcc atg agC | (SEQ ID No: 392) |
| 142 | g cct gca ggg gat ggG | (SEQ ID No: 393) |
| 143 | c cag cgc aag tgg gag A | (SEQ ID No: 394) |
| 144 | c cgc ggg tac cag cag A | (SEQ ID No: 395) |
| 145 | gcc tac ctg gag ggc cT | (SEQ ID No: 396) |
| 146 | tc cgc ggg tac cag cG | (SEQ ID No: 397) |
| 147 | ttc ctc cgc ggg tac cA | (SEQ ID No: 398) |
| 148 | gg tac cag cag gac gcT | (SEQ ID No: 399) |
| 149 | cg cag ttc gtg cgg ttG | (SEQ ID No: 400) |
| 150 | c cag agc gag gac ggt A | (SEQ ID No: 401) |

TABLE 1-6

| Probe No. | Base Sequence | |
|---|---|---|
| 151 | cag atg atg tat ggc tgc C | (SEQ ID No: 402) |
| 152 | g atg gag ccg cgg gcA | (SEQ ID No: 403) |
| 153 | g gac ctg cag aca cgg C | (SEQ ID No: 404) |
| 154 | gag acg ctg cag cgc G | (SEQ ID No: 405) |
| 155 | tgg gag gcg gcc cgt T | (SEQ ID No: 406) |

TABLE 1-6-continued

| Probe No. | Base Sequence | |
|---|---|---|
| 156 | gg gag gcg gcc cgt C | (SEQ ID No: 407) |
| 157 | g ggc tac gtg gac gac G | (SEQ ID No: 408) |
| 158 | cac acc atc cag ata atg C | (SEQ ID No: 409) |
| 159 | gtg cag cat gag ggt ctC | (SEQ ID No: 410) |
| 160 | gg tac cgg cag gac gcT | (SEQ ID No: 411) |
| 161 | c cac tcc atg agg tat ttc A | (SEQ ID No: 412) |
| 162 | g aca cgg aat gtg aag gG | (SEQ ID No: 413) |
| 163 | c cta gtt ctc ttt gga gct A | (SEQ ID No: 414) |
| 164 | gg ccg gac ggg cgc C | (SEQ ID No: 415) |
| 165 | gcc tac ctg gat ggc aC | (SEQ ID No: 416) |
| 166 | t ggc acg tgc gtg gag T | (SEQ ID No: 417) |
| 167 | gac cag gag aca ggg aaA | (SEQ ID No: 418) |
| 168 | gc acg gac ccc ccc aG | (SEQ ID No: 419) |
| 169 | ac gag gac ctg agc tcC | (SEQ ID No: 420) |
| 170 | gcg ccg tgg ata gag cG | (SEQ ID No: 421) |
| 171 | g cgg gcg ccg tgg atG | (SEQ ID No: 422) |
| 172 | c ccc atc gtg ggc atc C | (SEQ ID No: 423) |
| 173 | ctg cag cgc acg gac G | (SEQ ID No: 424) |
| 174 | g gac gcc ccc aag acG | (SEQ ID No: 425) |
| 175 | ctc ttt gga gct gtg atc G | (SEQ ID No: 426) |
| 176 | gac ggc aag gat tac atc T | (SEQ ID No: 427) |
| 177 | gtc tac ctg gag ggc aC | (SEQ ID No: 428) |
| 178 | cgg aga gcc tac ctg gaT | (SEQ ID No: 429) |
| 179 | g gac ggt tct cac acc C | (SEQ ID No: 430) |
| 180 | g ggc gag tgc gtg gag T | (SEQ ID No: 431) |

TABLE 1-7

| Probe No. | Base Sequence | |
|---|---|---|
| 181 | g gag tgg ctc cgc aga C | (SEQ ID No: 432) |
| 182 | ga acc ttc cag aag tgg gT | (SEQ ID No: 433) |
| 183 | cc atg agg tat ttc tac acT | (SEQ ID No: 434) |
| 184 | g agg tat ttc tac acc tcc A | (SEQ ID No: 435) |
| 185 | cgc ggg tac cgg cag C | (SEQ ID No: 436) |
| 186 | cat gtg gcg gag cag cT | (SEQ ID No: 437) |
| 187 | g ccg gag tat tgg gac G | (SEQ ID No: 438) |
| 188 | ag tgg gag gcg gcc cT | (SEQ ID No: 439) |
| 189 | gc ggg tac cgg cag gT | (SEQ ID No: 440) |

TABLE 1-7-continued

| Probe No. | Base Sequence | |
|---|---|---|
| 190 | tgg aga gcc tac ctg gaT | (SEQ ID No: 441) |
| 191 | tg ggg tcg gac ggg cA | (SEQ ID No: 442) |
| 192 | gc aga tac ctg gag aac C | (SEQ ID No: 443) |
| 193 | gac ctg ggg acc ctg cA | (SEQ ID No: 444) |
| 194 | gt tct cac acc atc cag aG | (SEQ ID No: 445) |
| 195 | g gcc ctg acc cag acc A | (SEQ ID No: 446) |
| 196 | c ctc ctc ctg cta ctc tT | (SEQ ID No: 447) |
| 197 | ctc ctc cgc ggg tac cA | (SEQ ID No: 448) |
| 198 | gac cga gtg gac ctg gC | (SEQ ID No: 449) |
| 199 | g aag gcc cac tca cag G | (SEQ ID No: 450) |
| 200 | ca cag att gac cga gtg G | (SEQ ID No: 451) |
| 201 | c aag tgg gag gcg gcc A | (SEQ ID No: 452) |
| 202 | c ttc aca tcc gtg tcc cC | (SEQ ID No: 453) |
| 203 | cag ccc acc atc ccc atT | (SEQ ID No: 454) |

TABLE 2-1

| Probe No. | Base Sequence | |
|---|---|---|
| 0 | cttcatcgcC gtgggcta | (SEQ ID No: 455) |
| 1 | acacggaatA tgaaggccc | (SEQ ID No: 456) |
| 2 | gcggagagTc tacctgg | (SEQ ID No: 457) |
| 3 | ggagggcCgg tgcgtg | (SEQ ID No: 458) |
| 4 | ggagggccGg tgcgtg | (SEQ ID No: 459) |
| 5 | gggccctgGg cttctac | (SEQ ID No: 460) |
| 6 | gtggtggtGc cttctgg | (SEQ ID No: 461) |
| 7 | ccttctggaG aggagcag | (SEQ ID No: 462) |
| 8 | agctcagatT accaagcgc | (SEQ ID No: 463) |
| 9 | ggtatttctC cacatccgt | (SEQ ID No: 464) |
| 10 | ggcagtggAg agcccc | (SEQ ID No: 465) |
| 11 | catccagatG atgtatggc | (SEQ ID No: 466) |
| 12 | cggagcagTt gagagcc | (SEQ ID No: 467) |
| 13 | cggagcagtT gagagcct | (SEQ ID No: 468) |
| 14 | ggagaggccT gagtattg | (SEQ ID No: 469) |
| 15 | ctgaccgagA gaacctgg | (SEQ ID No: 470) |
| 16 | gagcgaggCc ggttctc | (SEQ ID No: 471) |
| 17 | ggagggcTgg tgcgtg | (SEQ ID No: 472) |
| 18 | cacgcagttA gtgcggtt | (SEQ ID No: 473) |
| 19 | tcggggcTc tggccc | (SEQ ID No: 474) |
| 20 | gacacggaaA gtgaaggc | (SEQ ID No: 475) |

TABLE 2-1-continued

| Probe No. | Base Sequence | |
|---|---|---|
| 21 | tcacagactC accgagtg | (SEQ ID No: 476) |
| 22 | ctcacaccGt ccagagg | (SEQ ID No: 477) |
| 23 | ccgtccagaG gatgtatg | (SEQ ID No: 478) |
| 24 | ggtcggacTg gcgcttc | (SEQ ID No: 479) |
| 25 | ggcccatgTg gcggag | (SEQ ID No: 480) |
| 26 | ggagggcaCg tgcgtg | (SEQ ID No: 481) |
| 27 | catgagggtT tgcccaag | (SEQ ID No: 482) |
| 28 | cttcatcgcA gtgggcta | (SEQ ID No: 483) |
| 29 | ttgggacgGg gagacac | (SEQ ID No: 484) |
| 30 | gggtaccaCc agtacgc | (SEQ ID No: 485) |

TABLE 2-2

| Probe No. | Base Sequence | |
|---|---|---|
| 31 | taccaccagT acgcctac | (SEQ ID No: 486) |
| 32 | cgccctgaaA gaggacct | (SEQ ID No: 487) |
| 33 | cagctcagaC caccaagc | (SEQ ID No: 488) |
| 34 | cgtggagTgg ctccgc | (SEQ ID No: 489) |
| 35 | acagactcaT cgagtggac | (SEQ ID No: 490) |
| 36 | tggaccgcAg cggacat | (SEQ ID No: 491) |
| 37 | cctgaaagaA gacctgcg | (SEQ ID No: 492) |
| 38 | gactggcgAt tcctccg | (SEQ ID No: 493) |
| 39 | cccggccgTg gggag | (SEQ ID No: 494) |
| 40 | ccaggacacA gagctcgt | (SEQ ID No: 495) |
| 41 | cgcttcctGc gcgggt | (SEQ ID No: 496) |
| 42 | agtgggagAc ggcccat | (SEQ ID No: 497) |
| 43 | ggcccatgAg gcggag | (SEQ ID No: 498) |
| 44 | cggagcagTg gagagcc | (SEQ ID No: 499) |
| 45 | tctcacaccG tccagatg | (SEQ ID No: 500) |
| 46 | tttctacacC tccgtgtcc | (SEQ ID No: 501) |
| 47 | gaggatgtGt ggctgcg | (SEQ ID No: 502) |
| 48 | caggcctgAa ggggatg | (SEQ ID No: 503) |
| 49 | ccgtccagaG gatgtttg | (SEQ ID No: 504) |
| 50 | agaggatgtT tggctgcg | (SEQ ID No: 505) |
| 51 | actcacagaT tgaccgagt | (SEQ ID No: 506) |
| 52 | ggagcagcAg agagcct | (SEQ ID No: 507) |
| 53 | ggagggcgAg tgcgtg | (SEQ ID No: 508) |
| 54 | gtcatggcTc cccgaac | (SEQ ID No: 509) |

TABLE 2-2-continued

| Probe No. | Base Sequence | |
|---|---|---|
| 55 | agatgatgtT tggctgcga | (SEQ ID No: 510) |
| 56 | gggccctgAg cttctac | (SEQ ID No: 511) |
| 57 | ggcggacaAg gcagctc | (SEQ ID No: 512) |
| 58 | ccgagtgGac ctgggg | (SEQ ID No: 513) |
| 59 | ggacatggcG gctcagat | (SEQ ID No: 514) |
| 60 | tattgggacG gggagaca | (SEQ ID No: 515) |

TABLE 2-3

| Probe No. | Base Sequence | |
|---|---|---|
| 61 | g aca cgg aaC gtg aag gc | (SEQ ID No: 516) |
| 62 | tac gtg gac Aac acg cag | (SEQ ID No: 517) |
| 63 | cc acc aag cAc aag tgg g | (SEQ ID No: 518) |
| 64 | ag cag gag Agt ccg gag | (SEQ ID No: 519) |
| 65 | gag aca cgg Caa gtg aag | (SEQ ID No: 520) |
| 66 | g ggc tct caG tcc atg ag | (SEQ ID No: 521) |
| 67 | c gac gcc gGg agc cag | (SEQ ID No: 522) |
| 68 | g agg atg tCt ggc tgc g | (SEQ ID No: 523) |
| 69 | g aag gcc caG tca cag ac | (SEQ ID No: 524) |
| 70 | tc acc aag cAc aag tgg g | (SEQ ID No: 525) |
| 71 | ag ttg aga gCc tac ctg g | (SEQ ID No: 526) |
| 72 | tgc gtg gaG tgg ctc cg | (SEQ ID No: 527) |
| 73 | gcg gcc cGt gtg gcg | (SEQ ID No: 528) |
| 74 | g gcc cgt gTg gcg gag | (SEQ ID No: 529) |
| 75 | tac cag cag Tac gcc tac | (SEQ ID No: 530) |
| 76 | cgc ttc atc Tca gtg ggc | (SEQ ID No: 531) |
| 77 | gag gag aca Ggg aaa gtg | (SEQ ID No: 532) |
| 78 | g aca ggg aaA gtg aag gc | (SEQ ID No: 533) |
| 79 | ac tca cag aGt cac cga g | (SEQ ID No: 534) |
| 80 | ttc aca tcc Atg tcc cgg | (SEQ ID No: 535) |
| 81 | c ggg tat gaA cag cac gc | (SEQ ID No: 536) |
| 82 | g gac cgg aaC aca cgg aa | (SEQ ID No: 537) |
| 83 | tct cac acc Ctc cag atg | (SEQ ID No: 538) |
| 84 | ct cac acc Ctc cag agg | (SEQ ID No: 539) |
| 85 | cc ctc cag aGg atg tat g | (SEQ ID No: 540) |
| 86 | ggc cgc gAg gag ccc | (SEQ ID No: 541) |
| 87 | c cac cag tTc gcc tac g | (SEQ ID No: 542) |
| 88 | c tac ctg gaT ggc acg tg | (SEQ ID No: 543) |
| 89 | g gag cag cTg aga gcc t | (SEQ ID No: 544) |

TABLE 2-3-continued

| Probe No. | Base Sequence | |
|---|---|---|
| 90 | cag gag ggT ccg gag ta | (SEQ ID No: 545) |

TABLE 2-4

| Probe No. | Base Sequence | |
|---|---|---|
| 91 | ctg gag aac Cgg aag gag | (SEQ ID No: 546) |
| 92 | c ctg gat gCc acg tgc g | (SEQ ID No: 547) |
| 93 | c gtg ggg Tcg gac ggg | (SEQ ID No: 548) |
| 94 | acc gcg gcA gac atg gc | (SEQ ID No: 549) |
| 95 | c cgc ggg Aag ccc cg | (SEQ ID No: 550) |
| 96 | gcg gcc cGt gag gcg | (SEQ ID No: 551) |
| 97 | g gcc cgt gAg gcg gag | (SEQ ID No: 552) |
| 98 | cag atc acc Gag cgc aag | (SEQ ID No: 553) |
| 99 | ggg cgc ttA ctc cgc g | (SEQ ID No: 554) |
| 100 | c tac ctg Cag ggc cgg | (SEQ ID No: 555) |
| 101 | at tgg gac cTg cag aca c | (SEQ ID No: 556) |
| 102 | ag atc acc aGg cgc aag t | (SEQ ID No: 557) |
| 103 | gcc cgt cGg gcg gag | (SEQ ID No: 558) |
| 104 | aca ggg aaa Gtg aag gcc | (SEQ ID No: 559) |
| 105 | g aag tgg gcA gct gtg gt | (SEQ ID No: 560) |
| 106 | g tgg aga gCc tac ctg g | (SEQ ID No: 561) |
| 107 | tac atc gcc Ttg aac gag g | (SEQ ID No: 562) |
| 108 | cc atg agg tGt ttc tcc ac | (SEQ ID No: 563) |
| 109 | tac tac aac Gag agc gag g | (SEQ ID No: 564) |
| 110 | tc gcg ctc Cgc tac tac | (SEQ ID No: 565) |
| 111 | g cag aga gCc tac ctg g | (SEQ ID No: 566) |
| 112 | c tac cct gcA gag atc ac | (SEQ ID No: 567) |
| 113 | c cac cag taT gcc tac ga | (SEQ ID No: 568) |
| 114 | cag atc acc Cag cgc aag | (SEQ ID No: 569) |
| 115 | a ggc tcc caA tcc atg ag | (SEQ ID No: 570) |
| 116 | t gtg gtg gtA cct tct gg | (SEQ ID No: 571) |
| 117 | cg gag cag Tgg aga gtc | (SEQ ID No: 572) |
| 118 | c gtg gac Tgg ctc cgc | (SEQ ID No: 573) |
| 119 | c ttc ctc cAc ggg tac c | (SEQ ID No: 574) |
| 120 | g gcg gac aGg gcg gct | (SEQ ID No: 575) |

TABLE 2-5

| Probe No. | Base Sequence | |
|---|---|---|
| 121 | tca cag act Cac cga gag | (SEQ ID No: 576) |
| 122 | gg gac gag Cag aca ggg | (SEQ ID No: 577) |
| 123 | c cga gag aGc ctg cgg | (SEQ ID No: 578) |
| 124 | ac tca cag aTt gac cga ga | (SEQ ID No: 579) |
| 125 | g gag ccg Tgg gcg cc | (SEQ ID No: 580) |
| 126 | g atg gag cTg cgg gcg | (SEQ ID No: 581) |
| 127 | c tcc atg agC tat ttc tcc | (SEQ ID No: 582) |
| 128 | ggg gat ggG acc ttc ca | (SEQ ID No: 583) |
| 129 | cct tct gga Cag gag cag | (SEQ ID No: 584) |
| 130 | tac cag cag Aac gct tac g | (SEQ ID No: 585) |
| 131 | g gag ggc cTg tgc gtg | (SEQ ID No: 586) |
| 132 | g tac cag cGg gac gct t | (SEQ ID No: 587) |
| 133 | c ggg tac cAg cag gac g | (SEQ ID No: 588) |
| 134 | cag gac gcT tac gac gg | (SEQ ID No: 589) |
| 135 | gtg cgg ttG gac agc ga | (SEQ ID No: 590) |
| 136 | gag gac ggt Act cac acc | (SEQ ID No: 591) |
| 137 | t ggc tgc Cac gtg ggg | (SEQ ID No: 592) |
| 138 | ccg cgg gcA ccg tgg | (SEQ ID No: 593) |
| 139 | cag aca cgg Cat gtg aag | (SEQ ID No: 594) |
| 140 | g gcc cgt Tgg gcg gag | (SEQ ID No: 595) |
| 141 | g gcc cgt Cgg gcg ga | (SEQ ID No: 596) |
| 142 | tg gac gac Gcg cag ttc | (SEQ ID No: 597) |
| 143 | cag ata atg Cat ggc tgc g | (SEQ ID No: 598) |
| 144 | gag ggt ctC ccc aag cc | (SEQ ID No: 599) |
| 145 | agg tat ttc Acc aca tcc g | (SEQ ID No: 600) |
| 146 | at gtg aag gGc cac tca c | (SEQ ID No: 601) |
| 147 | c acg gag ctT gtg gag ac | (SEQ ID No: 602) |
| 148 | c ggg cgc Ctc ctc cg | (SEQ ID No: 603) |
| 149 | g gat ggc aCg tgc gtg g | (SEQ ID No: 604) |
| 150 | c ccc ccc aGg acg cat | (SEQ ID No: 605) |

TABLE 2-6

| Probe No. | Base Sequence | |
|---|---|---|
| 151 | ctg agc tcC tgg acc gc | (SEQ ID No: 606) |
| 152 | g ata gag cGg gag ggg c | (SEQ ID No: 607) |
| 153 | ccg tgg atG gag cag ga | (SEQ ID No: 608) |
| 154 | c acg gac Gcc ccc aag | (SEQ ID No: 609) |
| 155 | ag tgg gcg Tct gtg gtg | (SEQ ID No: 610) |
| 156 | c ccc aag acG cat atg ac | (SEQ ID No: 611) |

TABLE 2-6-continued

| Probe No. | Base Sequence | |
|---|---|---|
| 157 | g cag gag Agg ccg gag | (SEQ ID No: 612) |
| 158 | gat tac atc Tcc ctg aac g | (SEQ ID No: 613) |
| 159 | tc cgc aga Cac ctg gag | (SEQ ID No: 614) |
| 160 | g aag tgg gTg gct gtg g | (SEQ ID No: 615) |
| 161 | t ttc tac acT tcc gtg tcc | (SEQ ID No: 616) |
| 162 | ac acc tcc Atg tcc cgg | (SEQ ID No: 617) |
| 163 | c cgg cag Cac gcc tac | (SEQ ID No: 618) |
| 164 | tat tgg gac Gag gag aca c | (SEQ ID No: 619) |
| 165 | g gcg gcc cTt gtg gcg | (SEQ ID No: 620) |
| 166 | c cgg cag gTc gcc tac | (SEQ ID No: 621) |
| 167 | g gac ggg cAc ttc ctc c | (SEQ ID No: 622) |
| 168 | g acc ctg cAc ggc tac t | (SEQ ID No: 623) |
| 169 | cc atc cag aGg atg tat gg | (SEQ ID No: 624) |
| 170 | c cag acc Agg gcg ggc | (SEQ ID No: 625) |
| 171 | g cta ctc tTg ggg gcc c | (SEQ ID No: 626) |
| 172 | g gac ctg gCg acc ctg | (SEQ ID No: 627) |
| 173 | cac tca cag Gct gac cga | (SEQ ID No: 628) |
| 174 | g gcg gcc Agt gtg gcg | (SEQ ID No: 629) |
| 175 | gtg tcc cCg ccc ggc | (SEQ ID No: 630) |
| 176 | t ctg ccc Gag ccc ctc | (SEQ ID No: 631) |

TABLE 3-1

| Allele Number | Probe Number for Detection | | | | | | | | | | | | | |
|---|---|---|---|---|---|---|---|---|---|---|---|---|---|---|
| A*010101 | 0 | 1 | 2 | 3 | 4 | 5 | 6 | 7 | 8 | | | | | |
| A*010102 | 9 | | | | | | | | | | | | | |
| A*0102 | 10 | 11 | | | | | | | | | | | | |
| A*0103 | 12 | | | | | | | | | | | | | |
| A*0106 | 13 | 14 | | | | | | | | | | | | |
| A*0107 | 15 | 16 | 17 | | | | | | | | | | | |
| A*0108 | 18 | | | | | | | | | | | | | |
| A*0109 | 19 | | | | | | | | | | | | | |
| A*020101 | 20 | 21 | 22 | 23 | 24 | 25 | 26 | 27 | 28 | | | | | |
| A*020102 | 29 | 30 | 31 | 21 | 22 | 23 | 24 | 32 | 33 | 34 | 35 | 25 | 26 | 27 | 36 |
| A*020103 | 37 | | | | | | | | | | | | | |
| A*020104 | 38 | | | | | | | | | | | | | |
| A*020105 | 39 | | | | | | | | | | | | | |
| A*020106 | 40 | | | | | | | | | | | | | |
| A*020107 | 41 | 42 | | | | | | | | | | | | |
| A*020108 | 43 | | | | | | | | | | | | | |
| A*020109 | 31 | 21 | 22 | 23 | 24 | 25 | 44 | 26 | 27 | 42 | | | | |
| A*0202 | 45 | 42 | | | | | | | | | | | | |
| A*0203 | 20 | 46 | 47 | 48 | 27 | 28 | | | | | | | | |
| A*0204 | 20 | 21 | 22 | 24 | 25 | 26 | 27 | 28 | | | | | | |
| A*0205 | 45 | 28 | | | | | | | | | | | | |
| A*0206 | 20 | 49 | 21 | 22 | 23 | 24 | 25 | 26 | 27 | 28 | | | | |
| A*0207 | 50 | | | | | | | | | | | | | |
| A*0208 | 49 | 45 | | | | | | | | | | | | |
| A*0209 | 51 | | | | | | | | | | | | | |
| A*0210 | 20 | 23 | 52 | 25 | 26 | 27 | 28 | | | | | | | |
| A*0211 | 53 | 42 | 28 | | | | | | | | | | | |

TABLE 3-2

| Allele Number | Probe Number for Detection | | | | | | | | | | | | | |
|---|---|---|---|---|---|---|---|---|---|---|---|---|---|---|
| A*0212 | 20 | 25 | 54 | 27 | 28 | | | | | | | | | |
| A*0213 | 20 | 55 | 56 | 27 | 28 | | | | | | | | | |
| A*0214 | 45 | 26 | 28 | | | | | | | | | | | |
| A*0216 | 57 | 42 | 28 | | | | | | | | | | | |
| A*021701 | 20 | 58 | 24 | 25 | 26 | 27 | 28 | | | | | | | |
| A*021702 | 20 | 58 | 24 | 25 | 26 | 27 | 59 | | | | | | | |
| A*0218 | 60 | | | | | | | | | | | | | |
| A*0219 | 61 | 22 | 62 | 25 | 54 | 27 | | | | | | | | |
| A*022001 | 29 | 63 | 30 | 21 | 22 | 23 | 24 | 32 | 33 | 34 | 35 | 25 | 26 | 27 | 36 |
| A*022002 | 64 | | | | | | | | | | | | | |
| A*0221 | 65 | | | | | | | | | | | | | |
| A*0222 | 20 | 21 | 22 | 23 | 24 | 25 | 44 | 27 | 28 | | | | | |
| A*0224 | 29 | 30 | 31 | 21 | 22 | 23 | 24 | 32 | 33 | 35 | 25 | 26 | 27 | 36 |
| A*0225 | 46 | 66 | 26 | 27 | | | | | | | | | | |

TABLE 3-2-continued

| Allele Number | Probe Number for Detection | | | | | | | | | | | |
|---|---|---|---|---|---|---|---|---|---|---|---|---|
| A*0226 | 20 | 55 | 67 | 27 | 28 | | | | | | | |
| A*0227 | 22 | 68 | 69 | 27 | 36 | | | | | | | |
| A*0228 | 70 | 68 | 25 | 26 | 36 | | | | | | | |
| A*0229 | 71 | 68 | | | | | | | | | | |
| A*0230 | 72 | | | | | | | | | | | |
| A*0231 | 73 | | | | | | | | | | | |
| A*0233 | 74 | | | | | | | | | | | |
| A*0234 | 31 | 75 | 76 | 22 | 23 | 24 | 25 | 44 | 26 | 27 | 42 | |
| A*0235 | 31 | 75 | 22 | 23 | 24 | 32 | 33 | 34 | 35 | 25 | 26 | 27 | 36 |
| A*0236 | 29 | 30 | 31 | 21 | 22 | 23 | 24 | 32 | 33 | 34 | 35 | 25 | 26 | 27 |
| A*0237 | 22 | 68 | 25 | 54 | 27 | | | | | | | |

TABLE 3-3

| Allele Number | Probe Number for Detection | | | | | | | | | | | |
|---|---|---|---|---|---|---|---|---|---|---|---|---|
| A*0238 | 68 | 46 | 56 | | | | | | | | | |
| A*0239 | 52 | 62 | 77 | 25 | 26 | 78 | 27 | 79 | 36 | | | |
| A*0240 | 68 | 80 | 81 | 27 | 36 | | | | | | | |
| A*0241 | 49 | 29 | 30 | 31 | 21 | 22 | 23 | 24 | 82 | 34 | 35 | 25 | 26 | 27 | 36 |
| A*0242 | 83 | | | | | | | | | | | |
| A*0244 | 49 | 22 | 25 | 54 | 27 | 36 | | | | | | |
| A*0245 | 29 | 84 | 21 | 22 | 23 | 24 | 32 | 33 | 34 | 35 | 25 | 26 | 27 | 36 |
| A*0246 | 20 | 85 | 86 | 21 | 22 | 23 | 24 | 25 | 26 | 27 | | |
| A*0247 | 87 | | | | | | | | | | | |
| A*0248 | 85 | 68 | 25 | 26 | 78 | 27 | 79 | 36 | | | | |
| A*0249 | 29 | 30 | 31 | 21 | 22 | 23 | 24 | 32 | 33 | 34 | 35 | 68 | 25 | 27 | 36 |
| A*0250 | 88 | 31 | 21 | | | | | | | | | |
| A*0251 | 49 | 68 | 80 | 81 | 27 | 36 | | | | | | |
| A*0252 | 89 | 68 | 25 | 26 | | | | | | | | |
| A*0254 | 49 | 22 | 68 | 25 | 54 | 27 | | | | | | |
| A*0255 | 90 | 21 | 22 | 23 | 24 | 32 | 33 | 34 | 35 | 25 | 26 | 27 | 36 |
| A*0256 | 20 | 91 | 76 | 22 | 23 | 24 | 25 | 26 | 27 | 42 | | |
| A*0257 | 20 | 49 | 92 | 24 | 25 | 26 | 27 | 28 | | | | |
| A*0258 | 92 | 93 | 68 | 25 | 26 | 78 | 27 | 79 | 36 | | | |
| A*0259 | 94 | | | | | | | | | | | |
| A*0260 | 95 | 26 | | | | | | | | | | |
| A*030101 | 91 | 96 | 55 | 48 | 67 | 97 | | | | | | |
| A*030102 | 91 | 96 | 55 | 98 | 99 | | | | | | | |
| A*030103 | 100 | 91 | 96 | 55 | 48 | 67 | 97 | | | | | |
| A*0302 | 54 | 101 | | | | | | | | | | |
| A*0304 | 102 | | | | | | | | | | | |
| A*0305 | 91 | 96 | 17 | 62 | 55 | 48 | 67 | 27 | | | | |
| A*0306 | 103 | | | | | | | | | | | |
| A*0307 | 25 | 44 | 26 | 97 | | | | | | | | |

TABLE 3-4

| Allele Number | Probe Number for Detection | | | | | | |
|---|---|---|---|---|---|---|---|
| A*0308 | 96 | 55 | 48 | 67 | 97 | | |
| A*0309 | 76 | 61 | 55 | 48 | 67 | 97 | |
| A*0310 | 96 | 104 | 62 | 25 | 54 | 27 | 79 | 36 |
| A*110101 | 49 | 91 | 96 | 69 | 105 | 106 | |
| A*110102 | 107 | | | | | | |
| A*1102 | 108 | | | | | | |
| A*1103 | 80 | 109 | 110 | | | | |
| A*1104 | 49 | 91 | 96 | 69 | 27 | 79 | 36 |
| A*1105 | 111 | | | | | | |
| A*1106 | 91 | 76 | 61 | 69 | 105 | 106 | |
| A*1107 | 112 | | | | | | |
| A*1108 | 49 | 91 | 96 | 55 | | | |
| A*1109 | 113 | | | | | | |
| A*1110 | 49 | 90 | 96 | 69 | 106 | | |
| A*1111 | 114 | 96 | 69 | 106 | | | |
| A*1112 | 49 | 91 | 96 | 17 | 69 | 105 | 106 |
| A*1113 | 115 | | | | | | |
| A*1114 | 108 | 116 | | | | | |
| A*2301 | 117 | 118 | | | | | |

TABLE 3-4-continued

| Allele Number | Probe Number for Detection | | | | | | | | |
|---|---|---|---|---|---|---|---|---|---|
| A*2302 | 85 | 34 | 80 | 81 | 119 | 120 | 27 | | |
| A*2303 | 33 | 121 | 80 | 122 | | | | | |
| A*2304 | 85 | 34 | 80 | 81 | 122 | 78 | 27 | 79 | 36 |
| A*2305 | 123 | 122 | | | | | | | |
| A*2306 | 124 | | | | | | | | |
| A*2309 | 118 | | | | | | | | |
| A*240201 | 85 | 125 | 54 | 126 | 127 | | | | |
| A*240202 | 85 | 125 | 17 | 58 | 104 | 33 | 34 | 54 | 126 | 27 |
| A*240203 | 128 | | | | | | | | |
| A*240204 | 129 | | | | | | | | |

TABLE 3-5

| Allele Number | Probe Number for Detection | | | | | | | | | |
|---|---|---|---|---|---|---|---|---|---|---|
| A*240301 | 126 | 36 | 127 | | | | | | | |
| A*240302 | 130 | | | | | | | | | |
| A*2404 | 85 | 54 | 126 | 127 | | | | | | |
| A*2405 | 85 | 131 | 54 | 126 | 27 | | | | | |
| A*2406 | 85 | 34 | 62 | 25 | 44 | 120 | 27 | | | |
| A*2407 | 132 | 125 | 54 | 126 | 127 | | | | | |
| A*2408 | 133 | 28 | | | | | | | | |
| A*2410 | 85 | 54 | 126 | 105 | 106 | | | | | |
| A*2413 | 85 | 34 | 62 | 25 | 26 | 78 | 27 | | | |
| A*2414 | 85 | 24 | 33 | 34 | 62 | 54 | 126 | 27 | | |
| A*2415 | 85 | 125 | 17 | 92 | 33 | 34 | 62 | 54 | 126 | 27 |
| A*2417 | 85 | 125 | 17 | 58 | 104 | 34 | 62 | 54 | 126 | 27 |
| A*2418 | 34 | 55 | 48 | 67 | 97 | | | | | |
| A*2419 | 85 | 132 | 96 | 58 | 104 | 33 | 34 | 62 | 54 | 126 | 27 |
| A*2420 | 85 | 125 | 17 | 58 | 104 | 33 | 34 | 62 | 54 | 126 | 27 |
| A*2421 | 85 | 125 | 17 | 58 | 104 | 33 | 62 | 54 | 126 | 27 |
| A*2422 | 44 | 36 | 127 | | | | | | | |
| A*2423 | 85 | 54 | 126 | 27 | 134 | | | | | |
| A*2424 | 91 | 58 | 34 | 80 | 81 | 122 | 78 | 27 | | |
| A*2425 | 123 | 54 | | | | | | | | |
| A*2426 | 135 | | | | | | | | | |
| A*2427 | 136 | | | | | | | | | |
| A*2428 | 85 | 61 | 17 | 58 | 104 | 33 | 34 | 62 | 54 | 126 | 27 |
| A*2429 | 125 | 17 | 58 | 33 | 34 | 62 | 54 | 126 | 27 | |
| A*2430 | 85 | 21 | 125 | 17 | 58 | 104 | 33 | 34 | 62 | 54 | 126 | 27 |
| A*2431 | 137 | 25 | 54 | 27 | | | | | | |
| A*2432 | 138 | 34 | 54 | 27 | | | | | | |
| A*2433 | 62 | 25 | 54 | 27 | 42 | | | | | |
| A*2434 | 53 | 54 | | | | | | | | |

TABLE 3-6

| Allele Number | Probe Number for Detection | | | | | |
|---|---|---|---|---|---|---|
| A*2435 | 139 | | | | | |
| A*2437 | 140 | | | | | |
| A*2438 | 141 | | | | | |
| A*2501 | 138 | 142 | 28 | | | |
| A*2502 | 91 | 138 | 142 | 28 | | |
| A*2503 | 138 | 143 | 47 | 48 | 106 | |
| A*2504 | 138 | 47 | 56 | 106 | | |
| A*2601 | 90 | 48 | 142 | | | |
| A*2602 | 144 | | | | | |
| A*2603 | 21 | 61 | 48 | 142 | | |
| A*2604 | 145 | | | | | |
| A*2605 | 16 | 48 | 142 | | | |
| A*2606 | 146 | | | | | |
| A*2607 | 31 | 48 | 142 | | | |
| A*2608 | 56 | 142 | | | | |
| A*2609 | 147 | 131 | 143 | 47 | 27 | |
| A*2610 | 34 | 131 | 143 | 47 | 48 | |
| A*2612 | 131 | 143 | 66 | 44 | | |
| A*2613 | 91 | 147 | 131 | 143 | 47 | 48 |
| A*2614 | 49 | 90 | 147 | 148 | 55 | 48 |
| A*2615 | 149 | | | | | |

TABLE 3-6-continued

| Allele Number | Probe Number for Detection | | | | | |
|---|---|---|---|---|---|---|
| A*2616 | 10 | 90 | 147 | 131 | 143 | 47 | 48 |
| A*2617 | 150 | | | | | |
| A*2618 | 147 | 148 | 80 | 81 | 119 | |
| A*29010101 | 151 | | | | | |
| A*2902 | 152 | 36 | 28 | | | |
| A*2903 | 152 | 28 | | | | |
| A*2904 | 153 | 80 | | | | |
| A*2905 | 152 | 56 | 36 | | | |

TABLE 3-7

| Allele Number | Probe Number for Detection | | | | |
|---|---|---|---|---|---|
| A*2906 | 122 | 154 | | | |
| A*2907 | 152 | 58 | 122 | 36 | |
| A*3001 | 10 | 15 | 155 | | |
| A*3002 | 11 | 15 | 156 | 27 | 36 |
| A*3003 | 11 | 156 | 27 | 36 | |
| A*3004 | 11 | 25 | 36 | | |

TABLE 3-7-continued

| Allele Number | Probe Number for Detection | | | | | | | |
|---|---|---|---|---|---|---|---|---|
| A*3006 | 157 | | | | | | | |
| A*3007 | 86 | 156 | 27 | 36 | | | | |
| A*3008 | 49 | 15 | 155 | | | | | |
| A*3009 | 11 | 81 | 122 | 36 | | | | |
| A*3010 | 158 | | | | | | | |
| A*3011 | 10 | 155 | | | | | | |
| A*3012 | 15 | 156 | 27 | 36 | | | | |
| A*310102 | 15 | 121 | 159 | | | | | |
| A*3102 | 84 | 53 | 104 | 147 | 121 | 80 | 122 | 36 |
| A*3103 | 53 | 160 | 80 | 122 | 36 | | | |
| A*3104 | 160 | 159 | | | | | | |
| A*3105 | 15 | 53 | 104 | 147 | 121 | 80 | 122 | |
| A*3106 | 15 | 53 | 104 | 121 | 80 | 122 | 36 | |
| A*3107 | 15 | 125 | 147 | 121 | 81 | 122 | 36 | |
| A*3108 | 161 | 85 | 125 | 147 | 121 | 122 | 36 | |
| A*3109 | 162 | | | | | | | |
| A*3201 | 125 | 122 | 163 | | | | | |
| A*3202 | 54 | 163 | | | | | | |
| A*3203 | 125 | 164 | 80 | 122 | | | | |
| A*3204 | 138 | 97 | 165 | 166 | | | | |
| A*3205 | 167 | 125 | 122 | 163 | | | | |
| A*3206 | 138 | 25 | 26 | 27 | 36 | | | |
| A*3207 | 10 | 138 | 80 | 81 | 122 | 27 | 36 | |

TABLE 3-8

| Allele Number | Probe Number for Detection | | | | | | | |
|---|---|---|---|---|---|---|---|---|
| A*3301 | 168 | | | | | | | |
| A*3303 | 90 | 121 | 159 | | | | | |
| A*3304 | 169 | | | | | | | |
| A*3305 | 170 | | | | | | | |
| A*3306 | 171 | | | | | | | |
| A*3401 | 172 | | | | | | | |
| A*3402 | 47 | 67 | 27 | 36 | 173 | 174 | 175 | 28 |
| A*3403 | 160 | 55 | 67 | 27 | | | | |
| A*3404 | 70 | 47 | 67 | 36 | | | | |
| A*3405 | 176 | | | | | | | |
| A*3601 | 177 | 79 | | | | | | |
| A*3602 | 178 | | | | | | | |
| A*3603 | 179 | 177 | 79 | 36 | | | | |
| A*3604 | 105 | | | | | | | |
| A*4301 | 114 | 142 | 28 | | | | | |
| A*6601 | 91 | 96 | 48 | 142 | | | | |

TABLE 3-8-continued

| Allele Number | Probe Number for Detection | | | | | |
|---|---|---|---|---|---|---|
| A*6602 | 57 | 175 | 28 | | | |
| A*6603 | 47 | 57 | 180 | | | |
| A*6604 | 47 | 181 | | | | |
| A*680101 | 49 | 91 | 104 | 44 | 182 | 28 |
| A*680102 | 183 | 91 | 104 | 44 | 182 | 28 |
| A*6802 | 184 | 28 | | | | |
| A*680301 | 183 | 104 | 44 | 182 | 28 | |
| A*680302 | 183 | 35 | 44 | | | |
| A*6804 | 90 | 53 | 68 | 36 | | |
| A*6805 | 183 | 21 | 35 | 44 | | |
| A*6806 | 91 | 89 | 68 | 25 | | |
| A*6807 | 91 | 185 | 68 | 25 | | |

TABLE 3-9

| Allele Number | Probe Number for Detection | | | | | | | | |
|---|---|---|---|---|---|---|---|---|---|
| A*6808 | 186 | 182 | 28 | | | | | | |
| A*6809 | 183 | 54 | | | | | | | |
| A*6810 | 49 | 187 | 91 | 104 | 25 | 44 | 27 | 36 | |
| A*6812 | 183 | 91 | 44 | | | | | | |
| A*6813 | 49 | 91 | 104 | 44 | 182 | | | | |
| A*6814 | 68 | 154 | | | | | | | |
| A*6815 | 184 | 90 | 21 | | | | | | |
| A*6816 | 188 | | | | | | | | |
| A*6817 | 189 | 28 | | | | | | | |
| A*6819 | 68 | 25 | 44 | 190 | | | | | |
| A*6820 | 191 | | | | | | | | |
| A*6821 | 25 | 192 | | | | | | | |
| A*6822 | 193 | | | | | | | | |
| A*6823 | 183 | 194 | 35 | 44 | | | | | |
| A*6901 | 91 | 22 | 23 | 24 | 25 | 44 | 26 | 27 | 42 | 28 |
| A*7401 | 195 | 28 | | | | | | | |
| A*7402 | 196 | 96 | 164 | 197 | 121 | 122 | 36 | | |
| A*7403 | 198 | | | | | | | | |
| A*7404 | 31 | 96 | 164 | 80 | 122 | | | | |
| A*7405 | 199 | | | | | | | | |
| A*7406 | 21 | 61 | 164 | 80 | 122 | | | | |
| A*7407 | 53 | 200 | 164 | 80 | 122 | | | | |
| A*7408 | 201 | | | | | | | | |
| A*7409 | 202 | | | | | | | | |
| A*8001 | 203 | | | | | | | | |

TABLE 4-1

| Allele Number | Probe Number for Detection | | | | | | | | | | | | |
|---|---|---|---|---|---|---|---|---|---|---|---|---|---|
| A*010101 | 0 | 1 | 2 | 3 | 4 | 5 | 6 | 7 | | | | | |
| A*010102 | 8 | | | | | | | | | | | | |
| A*0102 | 9 | 10 | | | | | | | | | | | |
| A*0103 | 11 | | | | | | | | | | | | |
| A*0106 | 12 | 13 | | | | | | | | | | | |
| A*0107 | 14 | 15 | 16 | | | | | | | | | | |
| A*0108 | 17 | | | | | | | | | | | | |
| A*0109 | 18 | | | | | | | | | | | | |
| A*020101 | 19 | 20 | 21 | 22 | 23 | 24 | 25 | 13 | 26 | 27 | | | |
| A*020102 | 28 | 29 | 20 | 21 | 22 | 23 | 24 | 30 | 31 | 32 | 33 | 25 | 13 | 26 | 34 |
| A*020103 | 35 | | | | | | | | | | | | |
| A*020104 | 36 | | | | | | | | | | | | |
| A*020105 | 37 | | | | | | | | | | | | |
| A*020106 | 38 | | | | | | | | | | | | |
| A*020107 | 39 | 27 | | | | | | | | | | | |
| A*020108 | 40 | | | | | | | | | | | | |
| A*020109 | 20 | 21 | 22 | 23 | 24 | 25 | 12 | 13 | 26 | 27 | | | |
| A*0202 | 41 | 27 | | | | | | | | | | | |
| A*0203 | 19 | 42 | 43 | 44 | 26 | 27 | | | | | | | |
| A*0204 | 19 | 20 | 21 | 45 | 24 | 25 | 13 | 26 | 27 | | | | |
| A*0205 | 46 | 41 | 27 | | | | | | | | | | |
| A*0206 | 19 | 46 | 20 | 21 | 22 | 23 | 24 | 25 | 13 | 26 | 27 | | |
| A*0207 | 47 | | | | | | | | | | | | |
| A*0208 | 46 | 41 | | | | | | | | | | | |
| A*0209 | 48 | | | | | | | | | | | | |

TABLE 4-1-continued

| Allele Number | Probe Number for Detection | | | | | | |
|---|---|---|---|---|---|---|---|
| A*0210 | 19 | 49 | 50 | 25 | 13 | 26 | 27 |
| A*0211 | 51 | 27 | | | | | |
| A*0212 | 19 | 25 | 52 | 26 | 27 | | |
| A*0213 | 19 | 43 | 52 | 26 | 27 | | |

TABLE 4-2

| Allele Number | Probe Number for Detection | | | | | | | | | | | | | |
|---|---|---|---|---|---|---|---|---|---|---|---|---|---|---|
| A*0214 | 41 | 13 | 27 | | | | | | | | | | | |
| A*0216 | 53 | 27 | | | | | | | | | | | | |
| A*021701 | 54 | | | | | | | | | | | | | |
| A*021702 | 19 | 55 | 24 | 25 | 13 | 26 | 56 | | | | | | | |
| A*0218 | 57 | | | | | | | | | | | | | |
| A*0219 | 58 | 22 | 59 | 25 | 52 | 26 | | | | | | | | |
| A*022001 | 28 | 60 | 29 | 21 | 22 | 23 | 24 | 30 | 31 | 32 | 33 | 25 | 13 | 26 | 34 |
| A*022002 | 61 | | | | | | | | | | | | | |
| A*0221 | 62 | | | | | | | | | | | | | |
| A*0222 | 19 | 20 | 21 | 22 | 23 | 24 | 25 | 44 | 26 | 27 | | | | |
| A*0224 | 28 | 29 | 20 | 21 | 22 | 23 | 24 | 30 | 31 | 33 | 25 | 13 | 26 | 34 |
| A*0225 | 42 | 25 | 13 | 26 | | | | | | | | | | |
| A*0226 | 19 | 43 | 13 | 26 | 27 | | | | | | | | | |
| A*0227 | 22 | 63 | 52 | 26 | 34 | | | | | | | | | |
| A*0228 | 64 | 63 | 25 | 13 | 34 | | | | | | | | | |
| A*0229 | 65 | 63 | | | | | | | | | | | | |
| A*0230 | 66 | | | | | | | | | | | | | |
| A*0231 | 67 | | | | | | | | | | | | | |
| A*0233 | 68 | | | | | | | | | | | | | |
| A*0234 | 20 | 69 | 21 | 22 | 23 | 24 | 25 | 12 | 13 | 26 | 27 | | | |
| A*0235 | 20 | 69 | 22 | 23 | 24 | 30 | 31 | 32 | 33 | 25 | 13 | 26 | 34 | |
| A*0236 | 28 | 29 | 20 | 21 | 22 | 23 | 24 | 30 | 31 | 32 | 33 | 25 | 13 | 26 |
| A*0237 | 22 | 63 | 25 | 52 | 26 | | | | | | | | | |
| A*0238 | 63 | 42 | 52 | | | | | | | | | | | |
| A*0239 | 50 | 59 | 70 | 25 | 13 | 71 | 26 | 72 | 34 | | | | | |
| A*0240 | 63 | 73 | 74 | 26 | 34 | | | | | | | | | |
| A*0241 | 46 | 28 | 29 | 20 | 21 | 22 | 23 | 24 | 75 | 32 | 33 | 25 | 13 | 26 | 34 |
| A*0242 | 76 | | | | | | | | | | | | | |
| A*0244 | 46 | 22 | 25 | 52 | 26 | 34 | | | | | | | | |

TABLE 4-3

| Allele Number | Probe Number for Detection | | | | | | | | | | | | | |
|---|---|---|---|---|---|---|---|---|---|---|---|---|---|---|
| A*0245 | 28 | 20 | 21 | 22 | 23 | 24 | 30 | 31 | 32 | 33 | 25 | 13 | 26 | 34 |
| A*0246 | 19 | 77 | 78 | 21 | 22 | 23 | 24 | 25 | 13 | 26 | | | | |
| A*0247 | 79 | | | | | | | | | | | | | |
| A*0248 | 77 | 63 | 25 | 13 | 71 | 26 | 72 | 34 | | | | | | |
| A*0249 | 28 | 29 | 20 | 21 | 22 | 23 | 24 | 30 | 31 | 32 | 33 | 63 | 25 | 26 | 34 |
| A*0250 | 80 | 20 | 21 | | | | | | | | | | | |
| A*0251 | 46 | 63 | 73 | 74 | 26 | 34 | | | | | | | | |
| A*0252 | 81 | 63 | 25 | 13 | | | | | | | | | | |
| A*0254 | 46 | 22 | 63 | 25 | 52 | 26 | | | | | | | | |
| A*0255 | 82 | 21 | 22 | 23 | 24 | 30 | 31 | 32 | 33 | 25 | 13 | 26 | 34 | |
| A*0256 | 19 | 69 | 21 | 22 | 23 | 24 | 25 | 13 | 26 | 27 | | | | |
| A*0257 | 19 | 46 | 83 | 24 | 25 | 13 | 26 | 27 | | | | | | |
| A*0258 | 84 | 85 | 63 | 25 | 13 | 71 | 26 | 72 | 34 | | | | | |
| A*0259 | 86 | | | | | | | | | | | | | |
| A*0260 | 87 | 13 | | | | | | | | | | | | |
| A*030101 | 69 | 58 | 43 | 12 | 13 | 88 | | | | | | | | |
| A*030102 | 69 | 58 | 43 | 89 | 88 | | | | | | | | | |
| A*030103 | 90 | 69 | 58 | 43 | 12 | 13 | 88 | | | | | | | |
| A*0302 | 52 | 88 | | | | | | | | | | | | |
| A*0304 | 88 | 91 | | | | | | | | | | | | |
| A*0305 | 69 | 58 | 16 | 59 | 43 | 12 | 13 | 26 | | | | | | |
| A*0306 | 92 | | | | | | | | | | | | | |
| A*0307 | 25 | 12 | 13 | 88 | | | | | | | | | | |
| A*0308 | 58 | 43 | 12 | 13 | 88 | | | | | | | | | |
| A*0309 | 21 | 58 | 43 | 12 | 13 | 88 | | | | | | | | |
| A*0310 | 58 | 93 | 59 | 25 | 52 | 26 | 72 | 34 | | | | | | |

TABLE 4-3-continued

| Allele Number | Probe Number for Detection | | | | | |
|---|---|---|---|---|---|---|
| A*110101 | 46 | 69 | 58 | 52 | 72 | 34 |
| A*110102 | 94 | | | | | |
| A*1102 | 95 | | | | | |

TABLE 4-4

| Allele Number | Probe Number for Detection | | | | | | | | | |
|---|---|---|---|---|---|---|---|---|---|---|
| A*1103 | 96 | 97 | 52 | | | | | | | |
| A*1104 | 46 | 69 | 58 | 52 | 26 | 72 | 34 | | | |
| A*1105 | 98 | | | | | | | | | |
| A*1106 | 69 | 21 | 58 | 52 | 72 | 34 | | | | |
| A*1107 | 99 | | | | | | | | | |
| A*1108 | 46 | 69 | 58 | 43 | | | | | | |
| A*1109 | 100 | | | | | | | | | |
| A*1110 | 46 | 82 | 58 | 52 | 34 | | | | | |
| A*1111 | 101 | 58 | 52 | 34 | | | | | | |
| A*1112 | 46 | 69 | 58 | 16 | 52 | 72 | 34 | | | |
| A*1113 | 102 | | | | | | | | | |
| A*1114 | 95 | 103 | | | | | | | | |
| A*2301 | 104 | 13 | 71 | 105 | | | | | | |
| A*2302 | 77 | 32 | 73 | 74 | 44 | 106 | 26 | | | |
| A*2303 | 31 | 107 | 73 | 13 | | | | | | |
| A*2304 | 77 | 32 | 73 | 74 | 13 | 71 | 26 | 72 | 34 | |
| A*2305 | 108 | 13 | | | | | | | | |
| A*2306 | 109 | | | | | | | | | |
| A*2309 | 13 | 71 | 105 | | | | | | | |
| A*240201 | 77 | 110 | 52 | 111 | 105 | | | | | |
| A*240202 | 77 | 110 | 16 | 55 | 93 | 31 | 32 | 52 | 111 | 26 |
| A*240203 | 112 | | | | | | | | | |
| A*240204 | 113 | | | | | | | | | |
| A*240301 | 111 | 34 | 105 | | | | | | | |
| A*240302 | 77 | 52 | 111 | 26 | 72 | 34 | | | | |
| A*2404 | 77 | 52 | 111 | 105 | | | | | | |
| A*2405 | 77 | 114 | 52 | 111 | 26 | | | | | |
| A*2406 | 77 | 32 | 59 | 25 | 44 | 106 | 26 | | | |
| A*2407 | 69 | 110 | 52 | 111 | 105 | | | | | |

TABLE 4-5

| Allele Number | Probe Number for Detection | | | | | | | | | | |
|---|---|---|---|---|---|---|---|---|---|---|---|
| A*2408 | 115 | 116 | | | | | | | | | |
| A*2410 | 77 | 52 | 111 | 72 | 34 | | | | | | |
| A*2413 | 77 | 32 | 59 | 25 | 13 | 71 | 26 | | | | |
| A*2414 | 77 | 24 | 31 | 32 | 59 | 52 | 111 | 26 | | | |
| A*2415 | 77 | 110 | 16 | 83 | 31 | 32 | 59 | 52 | 111 | 26 | |
| A*2417 | 77 | 110 | 16 | 55 | 93 | 32 | 59 | 52 | 111 | 26 | |
| A*2418 | 32 | 43 | 12 | 13 | 88 | | | | | | |
| A*2419 | 77 | 69 | 58 | 55 | 93 | 31 | 32 | 59 | 52 | 111 | 26 |
| A*2420 | 77 | 110 | 16 | 55 | 93 | 31 | 32 | 59 | 52 | 111 | 26 |
| A*2421 | 77 | 110 | 16 | 55 | 93 | 31 | 59 | 52 | 111 | 26 | |
| A*2422 | 117 | 34 | 105 | | | | | | | | |
| A*2423 | 77 | 52 | 111 | 26 | 118 | | | | | | |
| A*2424 | 69 | 55 | 32 | 73 | 74 | 13 | 71 | 26 | | | |
| A*2425 | 109 | 52 | | | | | | | | | |
| A*2426 | 119 | | | | | | | | | | |
| A*2427 | 120 | | | | | | | | | | |
| A*2428 | 77 | 58 | 16 | 55 | 93 | 31 | 32 | 59 | 52 | 111 | 26 |
| A*2429 | 110 | 16 | 55 | 31 | 32 | 59 | 52 | 111 | 26 | | |
| A*2430 | 77 | 121 | 110 | 16 | 55 | 93 | 31 | 32 | 59 | 52 | 111 | 26 |
| A*2431 | 122 | 25 | 52 | 26 | | | | | | | |
| A*2432 | 123 | 32 | 52 | 26 | | | | | | | |
| A*2433 | 59 | 25 | 52 | 26 | 27 | | | | | | |
| A*2434 | 124 | 52 | | | | | | | | | |
| A*2435 | 125 | | | | | | | | | | |
| A*2437 | 126 | | | | | | | | | | |
| A*2438 | 127 | | | | | | | | | | |
| A*2501 | 123 | 128 | 129 | | | | | | | | |

TABLE 4-5-continued

| Allele Number | Probe Number for Detection | | | | |
|---|---|---|---|---|---|
| A*2502 | 69 | 123 | 128 | 129 | |
| A*2503 | 123 | 42 | 43 | 44 | 34 |

TABLE 4-6

| Allele Number | Probe Number for Detection | | | | | | |
|---|---|---|---|---|---|---|---|
| A*2504 | 123 | 43 | 52 | 34 | | | |
| A*2601 | 82 | 44 | 128 | | | | |
| A*2602 | 130 | | | | | | |
| A*2603 | 21 | 58 | 44 | 128 | | | |
| A*2604 | 131 | | | | | | |
| A*2605 | 15 | 44 | 128 | | | | |
| A*2606 | 132 | | | | | | |
| A*2607 | 20 | 44 | 128 | | | | |
| A*2608 | 52 | 128 | | | | | |
| A*2609 | 133 | 114 | 42 | 43 | 26 | | |
| A*2610 | 32 | 114 | 42 | 43 | 44 | | |
| A*2612 | 114 | 42 | 25 | 44 | | | |
| A*2613 | 69 | 133 | 114 | 42 | 43 | 44 | |
| A*2614 | 46 | 82 | 133 | 134 | 43 | 44 | |
| A*2615 | 135 | | | | | | |
| A*2616 | 9 | 82 | 133 | 114 | 42 | 43 | 44 |
| A*2617 | 136 | | | | | | |
| A*2618 | 133 | 134 | 73 | 74 | 44 | | |
| A*29010101 | 137 | | | | | | |
| A*2902 | 138 | 34 | 129 | | | | |
| A*2903 | 138 | 129 | | | | | |
| A*2904 | 139 | 73 | | | | | |
| A*2905 | 138 | 52 | 34 | | | | |
| A*2906 | 138 | 13 | 34 | | | | |
| A*2907 | 138 | 55 | 13 | 34 | | | |
| A*3001 | 9 | 14 | 140 | | | | |
| A*3002 | 10 | 14 | 141 | 26 | 34 | | |
| A*3003 | 10 | 141 | 26 | 34 | | | |
| A*3004 | 10 | 25 | 34 | | | | |

TABLE 4-7

| Allele Number | Probe Number for Detection | | | | | | |
|---|---|---|---|---|---|---|---|
| A*3006 | 142 | | | | | | |
| A*3007 | 78 | 141 | 26 | 34 | | | |
| A*3008 | 46 | 14 | 140 | | | | |
| A*3009 | 10 | 74 | 13 | 34 | | | |
| A*3010 | 143 | | | | | | |
| A*3011 | 9 | 140 | | | | | |
| A*3012 | 14 | 141 | 26 | 34 | | | |
| A*310102 | 14 | 107 | 144 | | | | |
| A*3102 | 20 | 51 | 93 | 133 | 107 | 73 | 13 | 34 |
| A*3103 | 51 | 134 | 73 | 13 | 34 | | |
| A*3104 | 134 | 144 | | | | | |
| A*3105 | 14 | 51 | 93 | 133 | 107 | 73 | 13 |
| A*3106 | 14 | 51 | 93 | 107 | 73 | 13 | 34 |
| A*3107 | 14 | 110 | 133 | 107 | 74 | 13 | 34 |
| A*3108 | 145 | 77 | 110 | 133 | 107 | 13 | 34 |
| A*3109 | 146 | | | | | | |
| A*3201 | 123 | 13 | 147 | 129 | | | |
| A*3202 | 123 | 52 | 147 | 129 | | | |
| A*3203 | 110 | 148 | 73 | 13 | | | |
| A*3204 | 123 | 88 | 149 | 34 | | | |
| A*3205 | 78 | 123 | 13 | 147 | 129 | | |
| A*3206 | 123 | 25 | 13 | 26 | 34 | | |
| A*3207 | 9 | 123 | 73 | 74 | 13 | 26 | 34 |
| A*3301 | 150 | | | | | | |
| A*3303 | 82 | 107 | 144 | | | | |
| A*3304 | 151 | | | | | | |
| A*3305 | 152 | | | | | | |
| A*3306 | 153 | | | | | | |
| A*3401 | 133 | 43 | 44 | 26 | 34 | 154 | 155 | 129 |

TABLE 4-8

| Allele Number | Probe Number for Detection | | | | | | | |
|---|---|---|---|---|---|---|---|---|
| A*3402 | 43 | 13 | 26 | 34 | 154 | 156 | 155 | 129 |
| A*3403 | 134 | 43 | 13 | 26 | | | | |
| A*3404 | 157 | 43 | 13 | 34 | | | | |
| A*3405 | 158 | | | | | | | |
| A*3601 | 26 | 72 | | | | | | |
| A*3602 | 88 | | | | | | | |
| A*3603 | 83 | 26 | 72 | 34 | | | | |
| A*3604 | 72 | | | | | | | |
| A*4301 | 101 | 128 | 129 | | | | | |
| A*6601 | 69 | 58 | 44 | 128 | | | | |
| A*6602 | 53 | 155 | 129 | | | | | |
| A*6603 | 43 | 53 | 34 | | | | | |
| A*6604 | 43 | 159 | | | | | | |
| A*680101 | 46 | 69 | 93 | 44 | 160 | 27 | | |
| A*680102 | 161 | 69 | 93 | 44 | 160 | 27 | | |
| A*6802 | 162 | 27 | | | | | | |
| A*680301 | 161 | 93 | 44 | 160 | 27 | | | |
| A*680302 | 161 | 33 | 44 | | | | | |
| A*6804 | 82 | 51 | 63 | 34 | | | | |
| A*6805 | 161 | 21 | 33 | 44 | | | | |
| A*6806 | 69 | 81 | 63 | 25 | | | | |
| A*6807 | 69 | 163 | 63 | 25 | | | | |
| A*6808 | 89 | 160 | 27 | | | | | |
| A*6809 | 161 | 52 | | | | | | |
| A*6810 | 46 | 164 | 69 | 93 | 25 | 44 | 26 | 34 |
| A*6812 | 161 | 69 | 44 | | | | | |
| A*6813 | 46 | 69 | 93 | 44 | 160 | | | |
| A*6814 | 46 | 164 | 69 | 93 | 25 | 44 | 26 | 34 |
| A*6815 | 162 | 82 | 21 | | | | | |

TABLE 4-9

| Allele Number | Probe Number for Detection | | | | | | | | |
|---|---|---|---|---|---|---|---|---|---|
| A*6816 | 165 | | | | | | | | |
| A*6817 | 166 | 27 | | | | | | | |
| A*6819 | 63 | 25 | 44 | 88 | | | | | |
| A*6820 | 167 | | | | | | | | |
| A*6821 | 25 | 91 | | | | | | | |
| A*6822 | 168 | | | | | | | | |
| A*6823 | 161 | 169 | 33 | 44 | | | | | |
| A*6901 | 82 | 69 | 22 | 23 | 24 | 25 | 12 | 13 | 26 | 27 |
| A*7401 | 170 | 129 | | | | | | | |
| A*7402 | 171 | 58 | 148 | 133 | 107 | 13 | 34 | | |
| A*7403 | 172 | | | | | | | | |
| A*7404 | 20 | 58 | 148 | 73 | 13 | | | | |
| A*7405 | 173 | | | | | | | | |
| A*7406 | 21 | 58 | 148 | 73 | 13 | | | | |
| A*7407 | 51 | 58 | 148 | 73 | 13 | | | | |
| A*7408 | 174 | | | | | | | | |
| A*7409 | 175 | | | | | | | | |
| A*8001 | 176 | | | | | | | | |

Example 3

Probes for Identification of HLA-B Allele

Extraction of DNA from 1 ml of human blood was performed using GFX Genomic Blood DNA Purification Kit from Amersham Biosciences in the same manner as in Example 1.

Next, quantitative PCR was carried out in the same manner as in Example 1 except that probes in the probe list B1 were used and 3 µl of the mixed primers consisting of 1 µl each of respective solutions of the following primers (10 pmol/µl):

```
CTGAGCTCTTCCTCCTACACA    (SEQ ID NO: 1155)

TCCTTCCCGTTCTCCAGGT      (SEQ ID NO: 1156)

AGGTCTCGGTCAGGGCCA       (SEQ ID NO: 1157)
```

After PCR amplification, the sample was identified being B*520101, referring to Amp Plot and Dissociation curves on a display of 5700 software and the allele-probe list B1 (described later).

Example 4

Extraction of DNA from 1 ml of human blood was performed in the same way as in Example 1. PCR of human HLA-B was then performed in the same manner as in Example 2 except that 2 µl of the mixed primer consisting of 1 µl each of the respective solutions of the following primers at 10 pmol/µl and 13 µl of ultra pure water used:

```
CTGAGCTCTTCCTCCTACACA    (SEQ ID NO: 1155)

GCTCCCACTCCATGAGGTATTTC. (SEQ ID NO: 1158)
```

At the same time, a DNA microarray was prepared to identify the allele in the specimen described above in the same manner as in Example 2, except that probes in the probe list B2 were to form the probe dots respectively.

Then, hybridization was performed using the above specimen and the prepared DNA microarray in the same manner as in Example 2. Fluorometry measurement was conducted with GenePix4000B (Axon). Referring to the allele-probe list B2 (described later), the sample was identified as B*520101.

```
Allele list
B*070201
                                                                (SEQ ID NO: 1159)
atgctggtcatggcgccccgaaccgtcctcctgctgctctcggcggccctggccctgaccgagacctgggccggctccca ctccatgaggtatttctacacctccGtgtcccggcccggccgcggggagccccgcttcatctcagtgggctacgtggacg acacccagttcgtggaggttcgacagcgacgccgcgagtccgagagaggagccgcgggcgccgtggatagagcaggagggg cggagtattgggaccggaacacacagatctacaaggcccaggcacagactgaccgagagagcctgcggaacctgcgcgg ctactacaaccagagcgaggccgggtctcacaccctccagagCatgtacggctgcgacgtggggccggacgggcgcctcc tccgcgggCatgaccagTacgcctacgacggcaaggattacatcgccctgaacgaggacctgcgctcctggaccgccgcg gacacggcggctcagatcacccagcgcaagtgggaggcggcccgtgaggcggagcagcGGagagcctacctggagggcgA gtgcgtggagtGgctccgcagatacctggagaacgggaaggacaagctgGagcgcgctgaccccccaaagacacacgtga cccaccacccatctctgaccatgaggccaccctgaggtgctgggccctgggtttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtcctaNNNgca gttgtggtcatcggagctgtggtcgctgctgtgatgtgtaggaggaagagttcaggtgga B*070202
                                                                (SEQ ID NO: 1160)
atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacccagttcgtgaggttcgacagcgacgccgcgagtccgagagaggagccgcgggcgccgtggatagagcaggagggg ccggagtattgggaccggaacacacagatctacaaggcccaggcacagactgaccgagagagcctgcggaacctgcgcgg ctactacaaccagagcgaggccgggtctcacaccctccagagcatgtacggctgcgacgtggggccggacgggcgcctcc tccgcgggcatgaccagtacgcctacgacggcaaggattacatcgccctgaacgaggacctgcgctcctggaccgccgcg gacacggcggctcagatcacccagcgcaagtgggaggcggcccgtgaggcggagcagcgagagcctacctggagggcga gtgcgtggagtggctccgcagGtacctggagaacgggaaggacaagctggagcgcgctgaccccccaaagacacacgtga cccaccacccatctctgaccatgaggccaccctgaggtgctgggccctgggtttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagtt
```

-continued

B*070203

(SEQ ID NO: 1161)
gctcccactccatgaggtatttctacacctccgtgtcccggcccggccgcggggagccccgcttcatctcagtgggctac gtggacgacacGcagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0703

(SEQ ID NO: 1162)
atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacccagttcgtgaggttcgacagcgacgccgcgagtccgagagaggagccgcgggcgccgtggatagagcaggagggg ccggagtattgggaccggaacacacagatctacaagaccaacAcacagactgaccgagagagcctgcggaacctgcgcgg ctactacaaccagagcgaggccgggtctcacaccctccagagcatgtacggctgcgacgtggggccggacgggcgcctcc tccgcgggcatgaccagtacgcctacgacggcaaggattacatcgccctgaacgaggacctgcgctcctggaccgccgcg gacacggcggctcagatcacccagcgcaagtgggaggcggcccgtgaggcggagcagcggagagcctacctggagggcga gtgcgtggagtggctccgcagatacctggagaacgggaaggacaagctggagcgcgctgacccccccaaagacacacgtga cccaccaccccatctctgaccatgaggccacccctgaggtgctgggccctgggtttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtcccta...gca gttgtggtcatcggagctgtggtcgctgctgtgatgtgtaggaggaagagttcaggtgga

B*0704

(SEQ ID NO: 1163)
atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacccagttcgtgaggttcgacagcgacgccgcgagtccgagagaggagccgcgggcgccgtggatagagcaggagggg ccggagtattgggaccggaacacacagatctacaaggcccaggcacagactgaccgagagagcctgcggaacctgcgcgg ctactacaaccagagcgaggccgggtctcacaccctccagagcatgtacggctgcgacgtggggccggacgggcgcctcc tccgcgggcatgaccagtacgcctacgacggcaaggattacatcgccctgaacgaggacctgcgctcctggaccgccgcg gacacggcggctcagatcacccagcgcaagtgggaggcggcccgtgaggcggagcaggaCagagcctacctggagggcga gtgcgtggagtggctccgcagatacctggagaacgggaaggacaagctggagcgcgctgacccccccaaagacacacgtga cccaccaccccatctctgaccatgaggccacccctgaggtgctgggccctgggtttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtcccta...gca gttgtggtcatcggagctgtggtcgctgctgtgatgtgtaggaggaagagttcaggtgga

B*0705

(SEQ ID NO: 1164)
atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacccagttcgtgaggttcgacagcgacgccgcgagtccgagagaggagccgcgggcgccgtggatagagcaggagggg -continued ccggagtattgggaccggaacacacagatctacaaggcccaggcacagactgaccgagagagcctgcggaacctgcgcgg ctactacaaccagagcgaggccgggtctcacaccctccagagcatgtacggctgcgacgtggggccggacgggcgcctcc tccgcgggcatAaccagtacgcctacgacggcaaggattacatcgccctgaacgaggacctgcgctcctggaccgccgcg gacacggcggctcagatcacccagcgcaagtgggaggcggcccgtgaggcggagcagcggagagcctacctggagggcga gtgcgtggagtggctccgcagatacctggagaacgggaaggacaagctggagcgcgctgacccccaaagacacacgtga cccaccacccatctctgaccatgaggccaccctgaggtgctgggccctgggtttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccAtccccatcgtgggcattgttgctggcctggctgtccta...gca gttgtggtcatcggagctgtggtcgctgctgtgatgtgtaggaggaagagttcaggtgga

B*0706

(SEQ ID NO: 1165)

atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacccagttcgtgaggttcgacagcgacgccgcgagtccgagagaggagccgcgggcgccgtggatagagcaggagggg ccggagtattgggaccggaacacacagatctacaaggcccaggcacagactgaccgagagagcctgcggaacctgcgcgg ctactacaaccagagcgaggccgggtctcacaccctccagagcatgtacggctgcgacgtggggccggacgggcgcctcc tccgcgggcatAaccagtacgcctacgacggcaaggattacatcgccctgaacgaggacctgcgctcctggaccgccgcg gacacggcggctcagatcacccagcgcaagtgggaggcggcccgtgaggcggagcagcggagagcctacctggagggcga gtgcgtggagtggctccgcagatacctggagaacgggaaggacaagctggagcgcgctgacccccaaagacacacgtga cccaccacccatctctgaccatgaggccaccctgaggtgctgggccctgggtttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagttcaggtgga

B*0707

(SEQ ID NO: 1166)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagGatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0708

(SEQ ID NO: 1167)

ggctcccactccatgaggtatttctacacctccgtgtcccggcccggccgcggggagccccgcttcatctcagtgggcta cgtggacgacacccagttcgtgaggttcgacagcgacgccgcgagtccgagagaggagccgcgggcgccgtggatagagc aggaggggccggagtattgggaccggaacacacagatctTcaagaccaacAcacagactgaccgagagagcctgcggaac ctgcgcggctactacaaccagagcgaggccgggtctcacaccctccagagcatgtacggctgcgacgtggggccggacgg gcgcctcctccgcgggcatgaccagtacgcctacgacggcaaggattacatcgccctgaacgaggacctgcgctcctgga ccgccgcggacacggcggctcagatcacccagcgcaagtgggaggcggcccgtgaggcggagcagcggagagcctacctg gagggcgagtgcgtggagtggctccgcagatacctggagaacgggaaggacaagctggagcgcgct

B*0709

(SEQ ID NO: 1168)

atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacccagttcgtgaggttcgacagcgacgccgcgagtccgagagaggagccgcgggcgccgtggatagagcaggagggg ccggagtattgggaccggaacacacagatctacaaggcccaggcacagactgaccgagagagcctgcggaacctgcgcgg ctactacaaccagagcgaggccgggtctcacaccctccagagcatgtacggctgcgacgtggggccggacgggcgcctcc tccgcgggcatgaccagtCcgcctacgacggcaaggattacatcgccctgaacgaggacctgcgctcctggaccgccgcg gacacggcggctcagatcacccagcgcaagtgggaggcggcccgtgaggcggagcagcggagagcctacctggagggcga gtgcgtggagtggctccgcagatacctggagaacgggaaggacaagctggagcgcgctg

B*0710

(SEQ ID NO: 1169)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctGcaaggcccaggcacagactgaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0711

(SEQ ID NO: 1170)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagaAcctgcggaacc tgcgcggctactacaaccagagcgaggccgggtctcacaccctccagagcatgtacggctgcgacgtggggccggacggg cgcctcctccgcgggcatgaccagtCcgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0712

(SEQ ID NO: 1171)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacatcAtccagaggatgtaTggctgcgacCtggggccCgacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0713

(SEQ ID NO: 1172)

gctcccactccatgaggtatttctacacctccgtgtcccggcccggccgcggggagccccgcttcatctcagtgggctac gtggacgacacccagttcgtgaggttcgacagcgacgccgcgagtccgagagggagccgcgggcgccgtgggtggagca ggaggggccggagtattgggaccgggagacacagaagtacaagcGccaggcacagGctgaccgagTgagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac

B*0714

(SEQ ID NO: 1173)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaTcAtccagagGatgtacggctgcgacgtggggccggacggg cgcctcctccgcgggTatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0715

(SEQ ID NO: 1174)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagGctgaccgagTgagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0716

(SEQ ID NO: 1175)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaagaccaacAcacagactTaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0717

(SEQ ID NO: 1176)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagcatgtacggctgcgacgtggggccggacggg cgcctcctccgcgggTatgaccagtCcgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0718

(SEQ ID NO: 1177)

atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacccagttcgtgaggttcgacagcgacgccgcgagtccgagagaggagccgcgggcgccgtggatagagcaggagggg ccggagtattgggaccggaacacacagatctacaaggcccaggcacagactgaccgagagagcctgcggaacctgcgcgg ctactacaaccagagcgaggccgggtctcacaTcatccagaggatgtaTggctgcgacgtggggccggacgggcgcctcc -continued tccgcgggcatgaccagtacgcctacgacggcaaggattacatcgccctgaacgaggacctgcgctcctggaccgccgcg gacacggcggctcagatcacccagcgcaagtgggaggcggcccgtgaggcggagcagcggagagcctacctggagggcga gtgcgtggagtggctccgcagatacctggagaacgggaaggacaagctggagcgcgctgacccccaaagacacacgtga cccaccaccccatctctgaccatgaggccaccctgaggtgctgggccctgggtttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagttcaggtgga

B*0719

(SEQ ID NO: 1178)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcaggaCagagcctacctgg agggcaCgtgcgtggagtggctccgcagatacctggagaacgggaaggaDacgctggagcgcgcGg

B*0720

(SEQ ID NO: 1179)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggccTgtgcgtggagtCgctccgcagatacctggagaacgggaaggacaagctggagcgcgctg

B*0721

(SEQ ID NO: 1180)

gctcccactccatgaggtatttctacacctccgtgtcccggcccggccgcggggagcTccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0722

(SEQ ID NO: 1181)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcgAacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0723

(SEQ ID NO: 1182)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggcCactacaaccagagcgaggccgggtctcacacctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0724

(SEQ ID NO: 1183)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacacctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcCtgtgcgtggagtggctccgcagatacctggagaacgggaaggacaagctggagcgcgctg

B*0725

(SEQ ID NO: 1184)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacacctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgTggcggagcaggaCagagcctacctgg agggcgagtgcgtggagtggctccgcagatacctggagaacgggaaggacaagctggagcgcgctg

B*0726

(SEQ ID NO: 1185)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacacctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcTgagagcctacctgg agggcgagtgcgtggagtggctccgcagatacctggagaacgggaaggacaagctggagcgcgctg

B*0727

(SEQ ID NO: 1186)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctCcaagaccaacacacagactTaccgagagGacctgcggaccc tgctcCgctactacaaccagagcgaggccgggtctcacacctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0728

(SEQ ID NO: 1187)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagcatgtacggctgcgacgtggggccggacggg cgcctcctccgcgggTatgaccagGacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0729

(SEQ ID NO: 1188)

gctcccactccatgaggtatttcGacaccgccAtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0730

(SEQ ID NO: 1189)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcCggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*0731

(SEQ ID NO: 1190)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcACgtgcgtggagtggctccgcagatacctggagaacgggaaggacaagctggagcgcgctg

B*0801

(SEQ ID NO: 1191)

atgctggtcatggcgccccgaaccgtcctcctgctgctctcggcggccctggccctgaccgagacctgggccggctccca ctccatgaggtatttcGacaccgccatgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggagtattgggaccggaacacacagatcttcaagaccaacacacagactgaccgagagagcctgcggaacctgcgcgg ctactacaaccagagcgaggccgggtctcacaccctccagagcatgtacggctgcgacgtggggccggacgggcgcctcc tccgcgggcataaccagtacgcctacgacggcaaggattacatcgccctgaacgaggacctgcgctcctggaccgcggcg gacaccgcggctcagatcacccagcgcaagtgggaggcggcccgtgtggcggagcaggacagagcctacctggagggcac gtgcgtggagtggctccgcagatacctggagaacgggaaggacacgctggagcgcgcggacccccccaaagacacacgtga -continued cccaccacccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*0802

(SEQ ID NO: 1192)

atgctggtcatggcgccccgaaccgtcctcctgctgctctcggcggccctggccctgaccgagacctgggccggctccca ctccatgaggtatttcGacaccgccatgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggagtattgggaccggaacacacagatcttcaagaccaacacacagactgaccgagagaacctgcgcaccgcgctcCg ctactacaaccagagcgaggccgggtctcacaccctccagagcatgtacggctgcgacgtggggccggacgggcgcctcc tccgcgggcataaccagtacgcctacgacggcaaggattacatcgccctgaacgaggacctgcgctcctggaccgcggcg gacaccgcggctcagatcacccagcgcaagtgggaggcggcccgtgtggcggagcaggacagagcctacctggagggcac gtgcgtggagtggctccgcagataCctggagaacgggaaggacacgctggagcgcgcggaccccccaaagacacacgtga cccaccacccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*0803

(SEQ ID NO: 1193)

ttcgacaccgccatgtcccggcccggccgcggggagccccgcttcatctcagtgggctacgtggacgacacgcagttcgt gaggttcgacagcgacgccgcgagtccgagagaggagccgcgggcgccgtggatagagcaggaggggccggagtattggg accggaacacacagatcttcaagaccaacacacagacttaccgagagaacctgcggaTcgCgctcCgctactacaaccag agcgaggccgggtctcacaccctccagagcatgtacggctgcgacgtggggccggacgggcgcctcctccgcgggcatAa ccagtacgcctacgacggcaaggattacatcgccctgaacgaggacctgcgctcctggaccgcggcggacaccgcggctc agatcacccagcgcaagtgggaggcggcccgtgTggcggagcaggaCagagcctacctggagggcACgtgcgtggagtgg ctccgcagatacctggagaacgggaaggacacgctggagcgcgcGg

B*0804

(SEQ ID NO: 1194)

gctcccactccatgaggtatttcGacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatctCcaagaccaacacacagactgaccgagagagcctgcggaacc tgcgcggctactacaaccagagcgaggccgggtctcacaccctccagagcatgtacggctgcgacgtggggccggacggg cgcctcctccgcgggcatAaccagtacgcctacgacggcaaggattacatcgccctgaacgaggacctgcgctcctggac cgcggcggacaccgcggctcagatcacccagcgcaagtgggaggcggcccgtgtggcggagcaggaCagagcctacctgg agggcAcgtgcgtggagtggctccgcagatacctggagaacgggaaggacacgctggagcgcgcGg

B*0805

(SEQ ID NO: 1195)

gctcccactccatgaggtatttcgacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagaCcttcaagaccaacacacagactgaccgagagagcctgcggaacc tgcgcggctactacaaccagagcgaggccgggtctcacaccctccagagcatgtacggctgcgacgtggggccggacggg cgcctcctccgcgggcataaccagtacgcctacgacggcaaggattacatcgccctgaacgaggacctgcgctcctggac cgcggcggacaccgcggctcagatcacccagcgcaagtgggaggcggcccgtgtggcggagcaggacagagcctacctgg agggcacgtgcgtggagtggctccgcagatacctggagaacgggaaggacacgctggagcgcgcgg

B*0806 (SEQ ID NO: 1196)

gctcccactccatgaggtatttcGacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatctTcaagaccaacacacagactgaccgagagaActgcggaacc tgcgcggctactacaaccagagcgaggccgggtctcacaccctccagagcatgtacggctgcgacgtggggccggacggg cgcctcctccgcgggcatAaccagtacgcctacgacggcaaggattacatcgccctgaacgaggacctgcgctcctggac cgccgcggacaccgcggctcagatcacccagcgcaagtgggaggcggcccgtgaggcggagcagcggagagcctacctgg agggcAcgtgcgtggagtggctccgcagatacctggagaacgggaaggacacgctggagcgcgcGg

B*0807 (SEQ ID NO: 1197)

gctcccactccatgaggtatttcGacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatctTcaagaccaacacacagactgaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgcggcggacaccgcggctcagatcacccagcgcaagtgggaggcggcccgtgtggcggagcaggaCagagcctacctgg agggcAcgtgcgtggagtggctccgcagatacctggagaacgggaaggacacgctggagcgcgcGg

B*0809 (SEQ ID NO: 1198)

gctcccactccatgaggtatttcGacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatcttcaagaccaacacacagactgaccgagagagcctgcggaacc tgcgcggctactacaaccagagcgaggccgggtctcacacttggcagacgatgtaTggctgcgacgtggggccggacggg cgcctcctccgcgggcatAaccagtacgcctacgacggcaaggattacatcgccctgaacgaggacctgcgctcctggac cgcggcggacaccgcggctcagatcacccagcgcaagtgggaggcggcccgtgtggcggagcaggaCagagcctacctgg agggcAcgtgcgtggagtggctccgcagatacctggagaacgggaaggacacgctggagcgcgcGg

B*0810 (SEQ ID NO: 1199)

gctcccactccatgaggtatttcGacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggGacacacagatctTcaagaccaacacacagactgaccgagagagcctgcggaacc tgcgcggctactacaaccagagcgaggccgggtctcacaccctccagagcatgtacggctgcgacgtggggccggacggg cgcctcctccgcgggcatAaccagtacgcctacgacggcaaggattacatcgccctgaacgaggacctgcgctcctggac cgcggcggacaccgcggctcagatcacccagcgcaagtgggaggcggcccgtgtggcggagcaggaCagagcctacctgg agggcAcgtgcgtggagtggctccgcagatacctggagaacgggaaggacacgctggagcgcgcGg

B*0811 (SEQ ID NO: 1200)

gctcccactccatgaggtatttcGacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatctTcaagaccaacacacagactgaccgagagagcctgcggaacc tgcgcggctactacaaccagagcgaggccgggtctcacaccctccagagcatgtacggctgcgacgtggggccggacggg cgcctcctccgcgggcatAaccagtacgcctacgacggcaaggattacatcgccctgaacgaggacctgcgctcctggac -continued cgcggcggacaccgcggctcagatcacccagcgcaagtgggaggcggcccgtgtggcggagcaggaCagagcctacctgg agggcgcgtgcgtggagtggctccgcagatacctggagaacgggaaggacacgctggagcgcgcGg

B*0812

(SEQ ID NO: 1201)

gctcccactccatgaggtatttcGacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatcttcaagaccaacacacagactgaccgagagagcctgcggaacc tgcgcggctactacaaccagagcgaggccgggtctcacaccctccagagGatgtacggctgcgacgtggggccggacggg cgcctcctccgcgggcatAaccagtacgcctacgacggcaaggattacatcgccctgaacgaggacctgcgctcctggac cgcggcggacaccgcggctcagatcacccagcgcaagtgggaggcggcccgtgtggcggagcaggaCagagcctacctgg agggcAcgtgcgtggagtggctccgcagatacctggagaacgggaaggacacgctggagcgcgcGg

B*0813

(SEQ ID NO: 1202)

gctcccactccatgaggtatttcGacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatctTcaagaccaacacacagactgaccgagagagcctgcggaacc tgcgcggctactacaaccagagcgaggccgggtctcacaccctccagagcatgtacggctgcgacgtggggccggacggg cgcctcctccgcgggcataaccagtacgcctacgacggcaaggattacatcgccctgaacgaggacctgcgctcctggac cgcggcggacaccgcggctcagatcacccagcgcaagtgggaggcggcccgtgtggcggagcagcTgagagcctacctgg agggcAcgtgcgtggagtggctccgcagatacctggagaacgggaaggacacgctggagcgcgcGg

B*0814

(SEQ ID NO: 1203)

gctcccactccatgaggtatttcGacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatcttcaagaccaacacacagactgaccgagagagcctgcggaacc tgcgcggctactacaaccagagcgaggccgggtctcacaccctccagagcatgtacggctgcgacgtggggccggacggg cgcctcctccgcgggtaccaccagDacgcctacgacggcaaggattacatcgccctgaacgaggacctgcgctcctggac cgcggcggacaccgcggctcagatcacccagcgcaagtgggaggcggcccgtgtggcggagcaggaCagagcctacctgg agggcAcgtgcgtggagtggctccgcagatacctggagaacgggaaggacacgctggagcgcgcGg

B*0815

(SEQ ID NO: 1204)

gctcccactccatgaggtatttcgacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatcttcaagaccaacacacagactgaccgagTgagcctgcggaacc tgcgcggctactacaaccagagcgaggccgggtctcacaccctccagagcatgtacggctgcgacgtggggccggacggg cgcctcctccgcgggcataaccagtacgcctacgacggcaaggattacatcgccctgaacgaggacctgcgctcctggac cgcggcggacaccgcggctcagatcacccagcgcaagtgggaggcggcccgtgtggcggagcaggaCagagcctacctgg agggcaCgtgcgtggagtggctccgcagatacctggagaacgggaaggacacgctggagcgcgcGg

B*0816

(SEQ ID NO: 1205)

gctcccactccatgaggtatttcgacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatcttcaagaccaacacacagGctgaccgagagagcctgcggaacc tgcgcggctactacaaccagagcgaggccgggtctcacaccctccagaggatgtacggctgcgacgtggggccggacggg cgcctcctccgcgggcataaccagtacgcctacgacggcaaggattacatcgccctgaacgaggacctgcgctcctggac -continued cgcggcggacaccgcggctcagatcacccagcgcaagtgggaggcggcccgtgtggcggagcaggaCagagcctacctgg agggcacgtgcgtggagtggctccgcagatacctggagaacgggaaggacacgctggagcgcgcGg

B*0817

(SEQ ID NO: 1206)

gctcccactccatgaggtatttcGacaccgccatgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccgggagacacagatctCcaagaccaacacacagactgaccgagagaAcctgcggaacc tgcgcggctactacaaccagagcgaggccgggtctcacaccctccagagcatgtacggctgcgacgtggggccggacggg cgcctcctccgcgggcataaccagtacgcctacgacggcaaggattacatcgccctgaacgaggacctgcgctcctggac cgcggcggacaccgcggctcagatcacccagcgcaagtgggaggcggcccgtgtggcggagcaggacagagcctacctgg agggcacgtgcgtggagtggctccgcagatacctggagaacgggaaggacacgctggagcgcgcggaccccccaaagaca cacgtgacccaccacccatctctgaccatgaggccaccctgaggtgctgggcccctgggCttctaccctgcggagatcac actgacctggcagcgggatggcgaggaccaaactcaggacactgagcttgtggagaccagaccagcaggagatagaacct tccagaagtgggcagctgtggtggtgccttctggagaagagcagagatacacatgccatgtacagcatgaggggctgccg aagcccctcaccctgagatggg

B*1301

(SEQ ID NO: 1207)

atgcgggtcacggcgccccgaaccctcctcctgctgctctgggggggcagtggccctgaccgagacctgggccggctccca ctccatgaggtatttctacaccgccatgtcccggcccggccgcggggagccccgcttcatcaccgtgggctacgtggacg acacccagttcgtgaggttcgacagcgacgccacgagtccgaggatggcgcccgggcgccatggatagagcaggaggggg ccggagtattgggaccgggagacacagatctccaagaccaacacacagacttaccgagagaacctgcgcaccgcgctccg ctactacaaccagagcgaggccgggtctcacatcAtccagaggatgtatggctgcgacctggggccggacgggcgcctcc tccgcgggcataaccagttagcctacgacggcaaggattacatcgccctgaacgaggacctgagctcctggaccgcggcg gacaccgcggctcagatcacccagcTcaagtgggaggcggcccgtgtggcggagcagctgagagcctacctggagggcga gtgcgtggagtggctccgcagatacctggagaacgggaaggagacgctgcagcgcgcggaccccccaaagacacacgtga cccaccacccatctctgaccatgaggccaccctgaggtgctgggcccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccgtccccatcgtgggcattgttgctggcctggctgtccta...gca gttgtggtcatcggagctgtggtcgctgctgtgatgtgtaggaggaagagCtcaggtgga

B*1302

(SEQ ID NO: 1208)

atgcgggtcacggcgccccgaaccctcctcctgctgctctgggggggcagtggccctgaccgagacctgggccggctccca ctccatgaggtatttctacaccgccatgtcccggcccggccgcggggagccccgcttcatcaccgtgggctacgtggacg acacccagttcgtgaggttcgacagcgacgccacgagtccgaggatggcgcccgggcgccatggatagagcaggaggggg ccggagtattgggaccgggagacacagatctccaagaccaacacacagacttaccgagagaacctgcgcaccgcgctccg ctactacaaccagagcgaggccgggtctcacacttggcagaCgatgtatggctgcgacctggggccggacgggcgcctcc tccgcgggcataaccagttagcctacgacggcaaggattacatcgccctgaacgaggacctgagctcctggaccgcggcg gacaccgcggctcagatcacccagcTcaagtgggaggcggcccgtgtggcggagcagctgagagcctacctggagggcga gtgcgtggagtggctccgcagatacctggagaacgggaaggagacgctgcagcgcgcggaccccccaaagacacacgtga cccaccacccatctctgaccatgaggccaccctgaggtgctgggcccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc -continued tcaccctgagatgggagccatcttcccagtccaccgtccccatcgtgggcattgttgctggcctggctgtccta...gca gttgtggtcatcggagctgtggtcgctgctgtgatgtgtaggaggaagagCtcaggtgga

B*1303

(SEQ ID NO: 1209)

atgcgggtcacggcgccccgaaccctcctcctgctgctctgggggcagtggccctgaccgagacctgggccggctccca ctccatgaggtatttctacaccgccatgtcccggcccggccgcggggagcccgcttcatcaccgtgggctacgtggacg acacccagttcgtgaggttcgacagcgacgccacgagtccgaggatggcgcccgggcgccatggatagagcaggagggg ccggagtattgggaccgggagacacagatctccaagaccaacacacagacttaccgagagaacctgcgcaccgcgctcCg ctactacaaccagagcgaggccgggtctcacacttggcagacgatgtaTggctgcgacctggggccggacgggcgcctcc tccgcgggcataaccagttAgcctacgacggcaaggattacatcgccctgaacgaggacctgagctcctggaccgcggcg gacaccgcggctcagatcacccagcgcaagtgggaggcggcccgtgTggcggagcagcTgagagcctacctggagggccT gtgcgtggagtggctccgcagatacctggagaacgggaaggagacgctgcagcgcgcggacccccccaaagacacacgtga cccaccacccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccgtccccatcgtgggcattgttgctggcctggctgtccta...gca gttgtggtcatcggagctgtggtcgctgctgtgatgtgtaggaggaagagCtcaggtgga

B*1304

(SEQ ID NO: 1210)

atgcgggtcacggcgccccgaaccctcctcctgctgctctgggggcagtggccctgaccgagacctgggccggctccca ctccatgaggtatttctacaccgccatgtcccggcccggccgcggggagcccgcttcatcaccgtgggctacgtggacg acacccagttcgtgaggttcgacagcgacgccacgagtccgaggatggcgcccgggcgccatggatagagcaggagggg ccggagtattgggaccgggagacacagatctccaagaccaacacacagacttaccgagagaacctgcgcaccgcgctccg ctactacaaccagagcgaggccgggtctcacacttggcagacgatgtatggctgcgacCtggggccggacgggcgcctcc tccgcgggcatgaccagtCcgcctacgacggcaaggattacatcgccctgaacgaggacctgagctcctggaccgcggcg gacacggcggctcagatcacccagcgcaagtgggaggcggcccgtgtggcggagcagcTgagagcctacctggagggcct gtgcgtggagtggctccgcagatacctggagaacgggaaggagacgctgcagcgcgcggacccccccaaagacacatgtga cccaccacccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccaaagcccc tcaccctgagatgggagccatcttcccaAtccaccgtccccatcgtgggcattgttgctggcctggctgtccta...gca gttgtggtcatcggagctgtggtcgctgctgtgatgtgtaggaggaagagctcaggtgga

B*1306

(SEQ ID NO: 1211)

gctcccactccatgaggtatttctacaccgccatgtcccggcccggccgcggggagcccgcttcatcaccgtgggctac gtggacgacacccagttcgtgaggttcgacagcgacgccacgagtccgaggatggcgcccgggcgccatggatagagca ggaggggccggagtattgggaccgggagacacagatctccaagaccaacacacagacttaccgagagaacctgcgcaccg cgctccgctactacaaccagagcgaggccgggtctcacatcatccagaggatgtatggctgcgacctggggccggacggg cgcctcctccgcgggcataaccagttagcctacgacggcaaggattacatcgccctgaacgaggacctgagctcctggac cgcggcggacaccgcggctcagatcacccagcTcaagtgggaggcggcccgtgtggcggagcagctgagagcctacctgg agggcaCgtgcgtggagtggctccgcagatacctggagaacgggaaggagacgctgcagcgcgcgg

B*1308

(SEQ ID NO: 1212)

atgcgggtcacggcgccccgaaccctcctcctgctgctctgggggcagtggccctgaccgagacctgggccggctccca ctccatgaggtatttctacaccgccatgtcccggcccggccgcggggagccccgcttcatcaccgtgggctacgtggacg acacccagttcgtgaggttcgacagcgacgccacgagtccgaggatggcgccccgggcgccatggatagagcaggagggg ccggagtattgggaccgggagacacagatctccaagaccaacacacagacttaccgagagaacctgcgcaccgcgctccg ctactacaaccagagcgaggccgggtctcacacttggcagacgatgtatggctgcgacctggggccggacgggcgcctcc tccgcgggcataaccagttagcctacgacggcaaggattacatcgccctgaacgaggacctgagctcctggaccgcggcg gacaccgcggctcagatcacccagctcaagtgggaggcggcccgtgtggcggagcagctgagagcctGcctggagggcga gtgcgtggagtggctccgcagatacctggagaacgggaaggagacgctgcagcgcgcggaccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccgtccccatcgtgggcattgttgctggcctggctgtcctc...gca gttgtggtcatcggagctgtggtcgctgctgtgatgtgtaggaggaagagctcaggtgga

B*1309

(SEQ ID NO: 1213)

gctcccactccatgaggtatttctacaccgccatgtcccggcccggccgcggggagccccgcttcatcaccgtgggctac gtggacgacacccagttcgtgaggttcgacagcgacgccacgagtccgaggatggcgccccgggcgccatggatagagca ggaggggccggagtattgggaccgggagacacagatctccaagaccaacacacagacttaccgagagagcctgcggaacc tgcgcggctactacaaccagagcgaggccgggtctcacacttggcagaCgatgtaTggctgcgacctggggccggacggg cgcctcctccgcgggcataaccagttAgcctacgacggcaaggattacatcgccctgaacgaggacctgagctcctggac cgcggcggacaccgcggctcagatcacccagcTcaagtgggaggcggcccgtgtggcggagcagctgagagcctacctgg agggcgagtgcgtggagtggctccgcagatacctggagaacgggaaggagacgctgcagcgcgcgg

B*1310

(SEQ ID NO: 1214)

gctcccactccatgaggtatttctacaccgccatgtcccggcccggccgcggggagccccgcttcatcaccgtgggctac gtggacgacacccagttcgtgaggttcgacagcgacgccacgagtccgaggatggcgccccgggcgccatggatagagca ggaggggccggagtattgggaccgggagacacagatctccaagaccaacacacagacttaccgagagaacctgcgcaccg cgctccgctactacaaccagagcgaggccgggtctcacaccctccagaggatgtacggctgcgacgtggggccggacggg cgcctcctccgcgggtatgaccagtCcgcctacgacggcaaggattacatcgccctgaacgaggacctgagctcctggac cgcggcggacaccgcggctcagatcacccagcTcaagtgggaggcggcccgtgtggcggagcagctgagagcctacctgg agggcgagtgcgtggagtggctccgcagatacctggagaacgggaaggagacgctgcagcgcgcgg

B*1311

(SEQ ID NO: 1215)

gctcccactccatgaggtatttctacaccgccatgtcccggcccggccgcggggagccccgcttcatcaccgtgggctac gtggacgacacccagttcgtgaggttcgacagcgacgccacgagtccgaggatggcgccccgggcgccatggatagagca ggaggggccggagtattgggaccgggagacacagatctccaagaccaacacacagacttaccgagagaacctgcgcaccg cgctccgctactacaaccagagcgaggccgggtctcacaccctccagaggatgtacggctgcgacctggggccggacggg cgcctcctccgcgggcataaccagttagcctacgacggcaaggattacatcgccctgaacgaggacctgagctcctggac cgcggcggacaccgcggctcagatcacccagcTcaagtgggaggcggcccgtgtggcggagcagctgagagcctacctgg agggcgagtgcgtggagtggctccgcagatacctggagaacgggaaggagacgctgcagcgcgcggaccccccaaagaca cacgtgacccaccaccccatctctgaccatgaggccaccctgaggtgctgggccctgggCttctaccctgcggagatcac actgacctggcagcgggatggcgaggaccaaactcaggacactgagcttgtggagaccagaccagcaggagatagaacct -continued tccagaagtgggcagctgtggtggtgccttctggagaagagcagagatacacatgccatgtacagcatgaggggctgccg aagcccctcaccctgagatggg

B*1401

(SEQ ID NO: 1216)

atgctggtcatggcgccccgaaccgtcctcctgctgctctcggcggccctggccctgaccgagacctgggccggctccca ctccatgaggtatttctacacctccgtgtcccggcccggccgcggggagcccgcttcatctcagtgggctacgtggacg acacgcagttcgtgaggttcgacagcgacgccgcgagtccgagagaggagccgcgggcgccgtggatagagcaggagggg ccggaatatttgggaccggaacacacagatctgcaagaccaacacacagactgaccgagagagcctgcggaacctgcgcgg ctactacaaccagagcgaggccgggtctcacaccctccagTggatgtatggctgcgacgtggggccggacgggcgcctcc tccgcgggtataaccagttcgcctacgacggcaaggattacatcgccctgaacgaggacctgagctcctggaccgcggcg gacaccgcggctcagatcacccagcgcaagtgggaggcggcccgtgaggcggagcagctgagagcctacctggagggcac gtgcgtggagtggctccgcagacacctggagaacgggaaggagacgctgcagcgcgcggacccccccaaagacacatgtga cccaccaccccatctctgaccatgaggccacctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga

B*1402

(SEQ ID NO: 1217)

atgctggtcatggcgccccgaaccgtcctcctgctgctctcggcggccctggccctgaccgagacctgggccggctccca ctccatgaggtatttctacaccGccgtgtcccggcccggccgcggggagcccgcttcatctcagtgggctacgtggacg acacgcagttcgtgaggttcgacagcgacgccgcgagtccgagagaggagccgcgggcgccgtggatagagcaggagggg ccggaatatttgggaccggaacacacagatctgcaagaccaacacacagactgaccgagagagcctgcggaacctgcgcgg ctactacaaccagagcgaggccgggtctcacaccctccagTggatgtatggctgcgacgtggggccggacgggcgcctcc tccgcgggtataaccagttcgcctacgacggcaaggattacatcgccctgaacgaggacctgagctcctggaccgcggcg gacaccgcggctcagatcacccagcgcaagtgggaggcggcccgtgaggcggagcagctgagagcctacctggagggcac gtgcgtggagtggctccgcagacacctggagaacgggaaggagacgctgcagcgcgcggacccccccaaagacacatgtga cccaccaccccatctctgaccatgaggccacctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga

B*1403

(SEQ ID NO: 1218)

gctcccactccatgaggtatttctacaccGccgtgtcccggcccggccgcggggagcccgcttcatctcagtgggctac gtggacgacacgcagttcgtgaggttcgacagcgacgccgcgagtccgagagaggagccgcgggcgccgtggatagagca ggaggggccggaatatttgggaccggaacacacagatctgcaagaccaacacacagactgaccgagagagcctgcggaacc tgcgcggctactacaaccagagcgaggccgggtctcacaccctccagTggatgtatggctgcgacgtggggccggacggg cgcctcctccgcgggtataaccagttcgcctacgacggcaaggattacatcgccctgaacgaggacctgagctcctggac cgcggcggacaccgcggctcagatcacccagcgcaagtgggaggcggcccgtgaggcggagcagctggagagcctacctgg agggcacgtgcgtggagtggctccgcagacacctggagaacgggaaggagacgctgcagcgcgcggacccccccaaagaca catgtgacccaccaccccatctctgaccatgaggccacctgaggtgctgggccctgggcttctaccctgcggagatcac actgacctggcagcgggatggcgaggaccaaactcaggacaccgagcttgtggagaccagaccagcaggagaCagaacct -continued tccagaagtgggcagctgtggtggtgccttctggagaagagcagagatacacatgccatgtacagcatgaggggctgccg aagcccctcaccctgagatggg

B*1404

(SEQ ID NO: 1219)

gctcccactccatgaggCatttctacaccgccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggaatattgggaccggaacacacagaactgcaagaccaacacacagactgaccgagagagcctgcggaacc tgcgcggctactacaaccagagcgaggccgggtctcacaccctccagtggatgtatggctgcgacgtggggccggacggg cgcctcctccgcgggtataaccagttcgcctacgacggcaaggattacatcgccctgaacgaggacctgagctcctggac cgcggcggacaccgcggctcagatcacccagcgcaagtgggaggcggcccgtgaggcggagcagctgagagcctacctgg agggcacgtgcgtggagtggctccgcagacacctggagaacgggaaggagacgctgcagcgcgcgg

B*1405

(SEQ ID NO: 1220)

atgctggtcatggcgccccgaaccgtcctcctgctgctctcggcggccctggccctgaccgagacctgggccggctccca ctccatgaggtatttctacaccGccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggaAtattgggaccggaacacacagatctgcaagaccaacacacagactgaccgagagagcctgcggaacctgcgcgg ctactacaaccagagcgaggccgggtctcacaccctccagagcatgtacggctgcgacgtggggccggacgggcgcctcc tccgcgggtataaccagttcgcctacgacggcaaggattacatcgccctgaacgaggacctgagctcctggaccgcggcg gacaccgcggctcagatcacccagcgcaagtgggaggcggcccgtgaggcggagcagcTgagagcctacctggagggcac gtgcgtggagtggctccgcagaCacctggagaacgggaaggagacgctgcagcgcgcGg

B*140601

(SEQ ID NO: 1221)

gctcccactccatgaggtatttctacaccGccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggaAtattgggaccggaacacacagatctgcaagaccaacacacagactgaccgagagagcctgcggaacc tgcgcggctactacaaccagagcgaggccgggtctcacaccctccagagGatgtacggctgcgacgtggggccggacggg cgcctcctccgcgggtataaccagttcgcctacgacggcaaggattacatcgccctgaacgaggacctgagctcctggac cgcggcggacaccgcggctcagatcacccagcgcaagtgggaggcggcccgtgaggcggagcagcTgagagcctacctgg agggcacgtgcgtggagtggctccgcagaCacctggagaacgggaaggagacgctgcagcgcgcGg

B*140602

(SEQ ID NO: 1222)

gctcccactccatgaggtatttctacaccGccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggaAtattgggaccggaacacacagatctgcaagaccaacacacagactgaccgagagagcctgcggaacc tgcgcggctactacaaccagagcgaggccgggtctcacaccctccagaggatgtaTggctgcgacgtggggccggacggg cgcctcctccgcgggtataaccagttcgcctacgacggcaaggattacatcgccctgaacgaggacctgagctcctggac cgcggcggacaccgcggctcagatcacccagcgcaagtgggaggcggcccgtgaggcggagcagcTgagagcctacctgg agggcacgtgcgtggagtggctccgcagaCacctggagaacgggaaggagacgctgcagcgcgcGg

B*15010101

(SEQ ID NO: 1223)

atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgcccgggcgccAtggatagagcaggaggggg ccggagtattgggacgggaGacacagatctCcaagaccaacacacagactTaccgagagagcctgcggaacctgcgcgg -continued ctactacaaccagagcgaggccgggtctcacaccctccagaggatgtacggctgcgacgtggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagTggagagcctacctggagggcct gtgcgtggagtggctccgcagatacctggagaacgggaaggagacgctgcagcgcgcggacccccccaaagacacatgtga cccaccaccccatctctgaccatgaggccaccctgaggtgctgggccctggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*150102

(SEQ ID NO: 1224)
gctcccactccatgaggtatttctacaccgccatgtcccggcccggccgcggggagccccgcttcatcgcagtgggctac gtggacgacacccagttcgtgaggttcgacagcgacgccgcgagtccgaggatggcgcccgggcgccatggatagagca gggggccggagtattgggaccgggagacacagatctccaagaccaacacacagacttaccgagagagcctgcggaacc tgcgcggctactacaaccagagcgaggccgggtctcacaccctccagaggatgtacggctgcgacgtggggccggacggg cgcctcctccgcgggcatgaccagtccgcctacgacggcaaAgattacatcgccctgaacgaggacctgagctcctggac cgcGgcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcGg

B*150103

(SEQ ID NO: 1225)
gctcccactccatgaggtatttctacaccgccatgtcccggcccggccgcggggagccccgcttcatcgcagtgggctac gtggacgacacccagttcgtgaggttcgacagcgacgccgcgagtccgaggatggcgcccgggcgccatggatagagca gggggccggagtattgggaccgggagacacagatctccaagaccaacacacagacttaccgagagagcctgcggaacc tgcgcggctactacaaccagagcgaggccgggtctcacaccctccagaggatgtacggctgcgacgtggggccggacggg cgcctcctccgcgggcatgaccagtccgcctacgacggcaaggattacatcgccctgaaTgaggacctgagctcctggac cgcggcggacacggcggctcagatcacccagcgcaagtgggaggcggcccgtgaggcggagcagtggagagcctacctgg agggcctgtgcgtggagtggctccgcagatacctggagaacgggaaggagacgctgcagcgcgcgg

B*150104

(SEQ ID NO: 1226)
gctcccactccatgaggtatttctacaccgccatgtcccggcccggccgcggggagccccgcttcatcgcagtgggctac gtggacgacacgcagttcgtgCggttcgacagcgacgccgcgagtccgaggatggcgcccgggcgccatggatagagca gggggccggagtattgggaccgggagacacagatctccaagaccaacacacagacttaccgagagagcctgcggaacc tgcgcggctactacaaccagagcgaggccgggtctcacaccctccagaggatgtacggctgcgacgtggggccggacggg cgcctcctccgcgggcatgaccagtccgcctacgacggcaaggattacatcgccctgaacgaggacctgagctcctggac cgcggcggacacggcggctcagatcacccagcgcaagtgggaggcggcccgtgaggcggagcagtggagagcctacctgg agggccTgtgcgtggagtggctccgcagatacctggagaacgggaaggagacgctgcagcgcgcgg

B*1502

(SEQ ID NO: 1227)
atgcgggtcacggcgcccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgcccgggcgccatggatagagcaggagggg ccggagtattgggaccggaacacacagatctCcaagaccaacacacagacttaccgagagagcctgcggaacctgcgcgg ctactacaaccagagcgaggccgggtctcacatcatccagaggatgtaTggctgcgacgtggggccggacgggcgcctcc tccgcgggTatgaccagtCcgcctacgacggcaaggattacatcgccctgaacgaggacctgagctcctggaccgcggcg gacacggcggctcagatcacccagcgcaagtgggaggcggcccgtgaggcggagcagcTgagagcctacctggagggcct -continued gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*1503

(SEQ ID NO: 1228)
atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatctcagtgggctacgtggacg acacGcagttcgtgaggttcgacagcgacgccgcgagtccgagagaggagccgcgggcgccgtggatagagcaggagggg ccggagtattgggaccgggaGacacagatctCcaagaccaacAcacagacttaccgagagagcctgcggaacctgcgcgg ctactacaaccagagcgaggccgggtctcacaccctccagagGatgtacggctgcgacgtggggccggacgggcgcctcc tccgcgggcatgaccagtCcgcctacgacggcaaggattacatcgccctgaacgaggacctgagctcctggaccgcggcg gacacggcggctcagatcacccagcgcaagtgggaggcggcccgtgaggcggagcagTgagagcctacctggagggcct gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*1504

(SEQ ID NO: 1229)
atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgcccgggcgccatggatagagcaggagggg ccggagtattgggaccgggagacacagatctccaagaccaacacacagacttaccgagagagcctgcggaacctgcgcgg ctactacaaccagagcgaggccgggtctcacacttggcagacgatgtaTggctgcgacgtggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagTggagagcctacctggagggcct gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*1505

(SEQ ID NO: 1230)
ggctcccactccatgaggtatttctacaccgccatgtcccggcccggccgcggggagccccgcttcatcgcagtgggcta cgtggacgacacccagttcgtgaggttcgacagcgacgccgcgagtccgaggatggcgcccgggcgccatggatagagc aggagggcccggagtattgggaccgggagacacagatctccaagaccaacacacagacttaccgagagagcctgcggaac ctgcgcggctactacaaccagagcgaggccgggtctcacaccctccagagGatgtacggctgcgacgtggggccggacgg gcgcctcctccgcgggcatgaccagtccgcctacgacggcaaggattacatcgccctgaacgaggacctgagctcctgga -continued ccgcggcggacacggcggctcagatcacccagcgcaagtgggaggcggcccgtgTggcggagcagcTgagagcctacctg gagggccTgtgcgtggagtggctccgcagatacctggagaacgggaaggagacgctgcagcgcgcggaccccccaaagac acatgtgacccaccacccatctctgaccatgaggccaccctgaggtgctgggccctgggcttctaccctgcggagatca cactgacctggcagcgggatggcgaggaccaaactcaggacacCgagcttgtggagaccagaccagcaggagatagaacc ttccagaagtgggcagctgtggtggtgccttctggagaagagcagagatacacatgccatgtacagcatgaggggctgcc gaagcccctcaccctgagatgggagccatcttcccagtccaccatccccatcgtgggcattgttgctggcctggctgtcc ta...gcagttgtggtcatcggagctgtggtcgctActgtgatgtgtaggaggaagagctcaggtgga

B*1506

(SEQ ID NO: 1231)

ggctcccactccatgaggtatttctacaccgccatgtcccggcccggccgcggggagcccgcttcatcgcagtgggcta cgtggacgacacccagttcgtgaggttcgacagcgacgccgcgagtccgaggatggcgcccgggcgccatggatagagc aggaggggccggagtattgggaccgggagacacagatctccaagaccaacacacagacttaccgagagagcctgcggaac ctgcgcggctactacaaccagagcgaggccgggtctcacaccctccagaggatgtTtggctgcgacgtggggccggacgg gcgcctcctccgcgggtatgaccagtccgcctacgacggcaaggattacatcgccctgaacgaggacctgagctcctgga ccgcggcggacacggcggctcagatcacccagcgcaagtgggaggcggcccgtgaggcggagcagcTgagagcctacctg gagggcctgtgcgtggagtggctccgcagatacctggagaacgggaaggagacgctgcagcgcgcggaccccccaaagac acatgtgacccaccacccatctctgaccatgaggccaccctgaggtgctgggccctgggcttctaccctgcggagatca cactgacctggcagcgggatggcgaggaccaaactcaggacaccgagcttgtggagaccagaccagcaggagatagaacc ttccagaagtgggcagctgtggtggtgccttctggagaagagcagagatacacatgccatgtacagcatgaggggctgcc gaagcccctcaccctgagatgggagccatcttcccagtccaccatccccatcgtgggcattgttgctggcctggctgtcc ta...gcagttgtggtcatcggagctgtggtcgctActgtgatgtgtaggaggaagagCtcaggtgga

B*1507

(SEQ ID NO: 1232)

ggctcccactccatgaggtatttctacaccgccatgtcccggcccggccgcggggagcccgcttcatcgcagtgggcta cgtggacgacacccagttcgtgaggttcgacagcgacgccgcgagtccgaggatggcgcccgggcgccAtggatagagc aggaggggccggagtattgggaccgggaGacacagatctCcaagaccaacacacagactTaccgagagagcctgcggaac ctgcgcggctactacaaccagagcgaggccgggtctcacaccctccagagcatgtacggctgcgacgtggggccggacgg gcgcctcctccgcgggcatgaccagtccgcctacgacggcaaggattacatcgccctgaacgaggacctgagctcctgga ccgcggcggacacggcggctcagatcacccagcgcaagtgggaggcggcccgtgaggcggagcagTgagagcctacctg gagggcctgtgcgtggagtggctccgcagatacctggagaacgggaaggagacgctgcagcgcgcggaccccccaaagac acatgtgacccaccacccatctctgaccatgaggccaccctgaggtgctgggccctgggcttctaccctgcggagatca cactgacctggcagcgggatggcgaggaccaaactcaggacaccgagcttgtggagaccagaccagcaggagatagaacc ttccagaagtgggcagctgtggtggtgccttctggagaagagcagagatacacatgccatgtacagcatgaggggctgcc gaagcccctcaccctgagatgggagccatcttcccagtccaccatccccatcgtgggcattgttgctggcctggctgtcc ta...gcagttgtggtcatcggagctgtggtcgctactgtgatgtgtaggaggaagagCtcaggtgga

B*1508

(SEQ ID NO: 1233)

atgcgggtcacggcgcccgaaccgtcctcctgctgctctcgggAgccctggccctgaccgagacctgggccggctccca ctccatgaggtatttctacaccgccatgtcccggcccggccgcggggagcccgcttcatcgcagtgggctacgtggacg acacccagttcgtgaggttcgacagcgacgccgcgagtccgaggatggcgcccgggcgccatggatagagcaggaggg ccggagtattgggaccggaacacacagatctTcaagaccaacacacagactTaccgagagagcctgcggaacctgcgcgg ctactacaaccagagcgaggccgggtctcacaccctccagaggatgtacggctgcgacgtggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagTgagagcctacctggagggcct

```
gtgcgtggagtggctccgcagatacctggagaacgggaaggagacgctgcagcgcgcggaccccccaaagacacatgtga ccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga
```

B*1509  
(SEQ ID NO: 1234)
```
atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggagtattgggaccggaacacacagatctgcaagaccaacacacagacttaccgagagagcctgcggaacctgcgcgg ctactacaaccagagcgaggccgggtctcacaccctccagaggatgtacggctgcgacgtggggccggacgggcgcctcc tccgcgggcataaccagtacgcctacgacggcaaAgattacatcgccctgaacgaggacctgagctcctggaccgcggcg gacacggcggctcagatcacccagcgcaagtgggaggcggcccgtgaggcggagcagcTgagagcctacctggagggcct gtgcgtggagtggctccgcagatacctggagaacgggaaggagacgctgcagcgcgcggaccccccaaagacacatgtga ccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga
```

B*1510  
(SEQ ID NO: 1235)
```
atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatctcagtgggctacgtggacg acacGcagttcgtgaggttcgacagcgacgccgcgagtccgagagaggagccgcgggcgccgtggatagagcaggagggg ccggagtattgggaccggaacacacagatctGcaagaccaacAcacagacttaccgagagagcctgcggaacctgcgcgg ctactacaaccagagcgaggccgggtctcacaccctccagagGatgtacggctgcgacgtggggccggacgggcgcctcc tccgcgggcatgaccagtacgcctacgacggcaaggattacatcgccctgaacgaggacctgagctcctggaccgcggcg gacacggcggctcagatcacccagcgcaagtgggaggcggcccgtgaggcggagcagcTgagagcctacctggagggcct gtgcgtggagtggctccgcagatacctggagaacgggaaggagacgctgcagcgcgcggaccccccaaagacacatgtga ccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga
```

B*151101  
(SEQ ID NO: 1236)
```
atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgccccgggcgccAtggatagagcaggagggg ccggagtattgggaccggaacacacagatctacaagaccaacacacagacttTaccgagagagcctgcggaacctgcgcgg ctactacaaccagagcgaggccgggtctcacaccctccagaggatgtacggctgcgacgtggggccggacgggcgcctcc
```

-continued tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagTggagagcctacctggagggcct gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*151102

(SEQ ID NO: 1237)
gctcccactccatgaggtatttctacaccgccatgtcccggcccggccgcggggagccccgcttcatcgcagtgggctac gtggacgacacccagttcgtgaggttcgacagcgacgccgcgagtccgaggatggcTccccgggcgccatggatagagca ggaggggccggagtattgggaccggaacacacagatctacaagaccaacacacagacttaccgagagagcctgcggaacc tgcgcggctactacaaccagagcgaggccgggtctcacaccctccagaggatgtacggctgcgacgtggggccggacggg cgcctcctccgcgggcatgaccagtccgcctacgacggcaaggattacatcgccctgaacgaggacctgagctcctggac cgcggcggacacggcggctcagatcacccagcgcaagtgggaggcggcccgtgaggcggagcagtggagagcctacctgg agggcctgtgcgtggagtggctccgcagatacctggagaacgggaaggagacgctgcagcgcgcgg

B*1512

(SEQ ID NO: 1238)
atgcgggtcacggcgccccgaaccgtcctcctgctgctctcgggagccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgccccgggcgccatggatagagcaggagggg ccggagtattgggaccgggagacacagatctccaagaccaacacacagacttaccgagagagcctgcggaacctgcgcgg ctactacaaccagagcgaggccgggtctcacaccctccagaggatgtacggctgcgacgtggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagtggagagcctacctggagggcct gtgcgtggaCgggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagctcaggtgga

B*1513

(SEQ ID NO: 1239)
atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgccccgggcgccatggatagagcaggagggg ccggagtattgggaccggaacacacagatctccaagaccaacacacagacttaccgagagaacctgcggatcgcgctcCg ctactacaaccagagcgaggccgggtctcacatcatccagaggatgtaTggctgcgacgtggggccggacgggcgcctcc tccgcgggTatgaccagtCcgcctacgacggcaaggattacatcgccctgaacgaggacctgagctcctggaccgcggcg gacacggcggctcagatcacccagcgcaagtgggaggcggcccgtgaggcggagcagTgagagcctacctggagggcct gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa -continued gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*1514

(SEQ ID NO: 1240)
atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgcccgggcgccatggatagagcaggagggg ccggagtattgggaccgggagacacagatctccaagaccaacacacagacttaccgagagagcctgcggaacctgcgcgg ctactacaaccagagcgaggccgggtctcacaccctccagaggatgtacggctgcgacgtggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagtggagagcctacctggagggcct gtgcgtggagtCgctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*1515

(SEQ ID NO: 1241)
atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgcccgggcgccAtggatagagcaggagggg ccggagtattgggaccggaacacacagatctCcaagaccaacacacagactTaccgagagagcctgcggaacctgcgcgg ctactacaaccagagcgaggccgggtctcacaccctccagaggatgtacggctgcgacgtggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagTggagagcctacctggagggcct gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*1516

(SEQ ID NO: 1242)
atgcgggtcacggcgccccgaaccgtcctcctgctgctctcgggagccctggccctgaccgagacctgggccggctccca ctTcatgaggtatttctacaccgccatgtcccggcccggccgcggggagccccgcttcatcgcagtgggctacgtggacg acacgcagttcgtgaggttcgacagcgacgccgcgagtccgaggatggcgcccgggcgccatggatagagcaggagggg ccggagtattgggaccgggagacacggaacatgaaggcctccgcgcagacttaccgagagaacctgcggatcgcgctccg ctactacaaccagagcgaggccgggtctcacacttggcagaggatgtatggctgcgacctggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagctgagagcctacctggagggcct gtgcgtggagtggctccgcagatacctggagaacgggaaggagacgctgcagcgcgcggaccccccaaagacacatgtga -continued cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*151701

(SEQ ID NO: 1243)

atgcgggtcacggcgccccgaaccgtcctcctgctgctctcgggagccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgcccgggcgccatggatagagcaggagggg ccggagtattgggaccgggagacacggaacatgaaggcctccgcGcagacttaccgagagaacctgcggatcgcgctccg ctactacaaccagagcgaggccgggtctcacaccctccagaggatgtacggctgcgacgtggggccggacgggcgcctcc tccgcgggtaccaccagGacgcctacgacggcaaggattacatcgccctgaacgaggacctgagctcctggaccgcggcg gacacggcggctcagatcacccagcgcaagtgggaggcggcccgtgaggcggagcagctgagagcctacctggagggcct gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcaggtgga

B*1518

(SEQ ID NO: 1244)

atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatctcagtgggctacgtggacg acacGcagttcgtgaggttcgacagcgacgccgcgagtccgagagaggagccgcgggcgccgtggatagagcaggagggg ccggagtattgggaccggaacacacagatctGcaagaccaacAcacagacttaccgagagagcctgcggaacctgcgcgg ctactacaaccagagcgaggccgggtctcacaccctccagagGatgtacggctgcgacgtggggccggacgggcgcctcc tccgcgggcatgaccagtCcgcctacgacggcaaggattacatcgccctgaacgaggacctgagctcctggaccgcggcg gacacggcggctcagatcacccagcgcaagtgggaggcggcccgtgaggcggagcagcTgagagcctacctggagggcct gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*1519

(SEQ ID NO: 1245)

atgcgggtcacggcgccccgaaccgtcctcctgctgctctcgggagccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgcccgggcgccatggatagagcaggagggg ccggagtattgggaccgggagacacagatctccaagaccaacacacagacttaccgagagagcctgcggaacctgcgcgg ctactacaaccagagcgaggccgggtctcacaccctccagaggatgtacggctgcgacgtggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagtggagagcctacctggagggcct -continued gtgcgtggacgggctccgcagatacctggagaacgggaaggagacgctgcagcgcgcggacccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgcTttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagctcaggtgga

B*1520

(SEQ ID NO: 1246)

atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgccccgggcgccatggatagagcaggagggg ccggagtattgggaccgggagacacagatctccaagaccaacacacagacttaccgagagagcctgcggaacctgcgcgg ctactacaaccagagcgaggccgggtctcacatcatccagaggatgtatggctgcgacctggggcccgacgggcgcctcc tccgcgggcatgaccagtccgcctacgacggcaaggattacatcgccctgaacgaggacctgagctcctggaccgcggcg gacaccgcggctcagatcacccagcgcaagtgggaggcggcccgtgtggcggagcagctgagagcctacctggagggcct gtgcgtggagtggctccgcagatacctggagaacgggaaggagacgctgcagcgcgcggacccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*1521

(SEQ ID NO: 1247)

atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgccccgggcgccatggatagagcaggagggg ccggagtattgggaccggaacacacagatctGcaagaccaacacacagacttaccgagagagcctgcggaacctgcgcgg ctactacaaccagagcgaggccgggtctcacatcatccagaggatgtaTggctgcgacgtggggccggacgggcgcctcc tccgcgggTatgaccagtCcgcctacgacggcaaggattacatcgccctgaacgaggacctgagctcctggaccgcggcg gacacggcggctcagatcacccagcgcaagtgggaggcggcccgtgaggcggagcagcTgagagcctacctggagggcct gtgcgtggagtggctccgcagatacctggagaacgggaaggagacgctgcagcgcgcggacccccaaagacacatgtga cccaccaccccatctctgaccatgaggccaccctgaggtgctgggccctgggcttctaccctgcggagatcacactgacc tggcagcgggatggcgaggaccaaactcaggacaCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*1523

(SEQ ID NO: 1248)

atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggagtattgggaccggaacacacagatctGcaagaccaacAcacagacttaccgagagaacctgcggatcgcgctcCg ctactacaaccagagcgaggccgggtctcacaccctccagagGatgtacggctgcgacgtggggccggacgggcgcctcc -continued tccgcgggcatgaccagtCcgcctacgacggcaaggattacatcgccctgaacgaggacctgagctcctggaccgcggcg gacacggcggctcagatcacccagcgcaagtgggaggcggcccgtgaggcggagcagcTgagagcctacctggagggcct gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga B*1524 (SEQ ID NO: 1249)
gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggaccgggagacacagatctccaagaccaacacacagacttaccgagagaacctgcggatcg CgctcCgctactacaaccagagcgaggccgggtctcacaccctccagagGatgtacggctgcgacgtggggccggacggg cgcctcctccgcgggcatgaccagtCcgcctacgacggcaaggattacatcgccctgaacgaggacctgagctcctggac cgcGgcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcGg B*1525 (SEQ ID NO: 1250)
atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgccccgggcgccatggatagagcaggagggg ccggagtattgggaccgggaGacacagatctCcaagaccaacacacagacttaccgagagagcctgcggaacctgcgcgg ctactacaaccagagcgaggccgggtctcacatcatccagaggatgtaTggctgcgacgtggggccggacgggcgcctcc tccgcgggTatgaccagtCcgcctacgacggcaaggattacatcgccctgaacgaggacctgagctcctggaccgcggcg gacacggcggctcagatcacccagcgcaagtgggaggcggcccgtgaggcggagcagcTgagagcctacctggagggcct gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga B*1527 (SEQ ID NO: 1251)
gaggtatttctacaccgccatgtcccggcccggccgcggggagccccgcttcatcgcagtgggctacgtggacgacaccc agttcgtgaggttcgacagcgacgccgcgagtccgaggatggcgccccgggcgccatggatagagcaggaggggccggag tattgggaccgggagacacagatctccaagaccaacacacagacttaccgagagagcctgcggaacctgcgcggctacta caaccagagcgaggccgggtctcacaccctccagaggatgtTtggctgcgacgtggggccggacgggcgcctcctccgcg ggcatgaccagtccgcctacgacggcaaggattacatcgccctgaacgaggacctgagctcctggaccgcggcggacacg gcggctcagatcacccagcgcaagtgggaggcggcccgtgaggcggagcagTggagagcctacctggagggccTgtgcgt ggagtggctccgcagatacctggagaacgggaaggagacgctgcagcgc B*1528 (SEQ ID NO: 1252)
atgcgggtcacggcgccccgaaccgtcctcctgctgctctcgggagccctggccctgaccgagacctgggccggctccca ctccatgaggtatttctacaccgccatgtcccggcccggccgcggggagccccgcttcatcgcagtgggctacgtggacg -continued acacccagttcgtgaggttcgacagcgacgccgcgagtccgaggatggcgcccgggcgccatggatagagcaggagggg ccggagtattgggaccggggagaTacagatctccaagaccaacacacagacttaccgagagagcctgcggaacctgcgcgg ctactacaaccagagcgaggccgggtctcacaccctccagaggatgtacggctgcgacgtggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagtggagagcctacctggagggcct gtgcgtggagtggctccgcagatacctggagaacgggaaggagacgctgcagcgcgcggaccccccaaagacacatgtga cccaccacccatctctgaccatgaggccaccctgaggtgctgggccctggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatggg B*1529
(SEQ ID NO: 1253)
atgcgggtcacggcgccccgaaccgtcctcctgctgctctcggGAgccctggccctgaccgagacctgggccggctccca ctccatgaggtatttctacaccgccatgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggagtattgggaccggaacacacagatctTcaagaccaacAcacagacttaccgagagagcctgcggaacctgcgcgg ctactacaaccagagcgaggccgggtctcacaccctccagagGatgtacggctgcgacgtggggccggacgggcgcctcc tccgcgggcatgaccagtCcgcctacgacggcaaggattacatcgccctgaacgaggacctgagctcctggaccgcggcg gacacggcggctcagatcacccagcgcaagtgggaggcggcccgtgaggcggagcagcTgagagcctacctggagggcct gtgcgtggagtggctccgcagatacctggagaacgggaaggagacgctgcagcgcgcggaccccccaaagacacatgtga cccaccacccatctctgaccatgaggccaccctgaggtgctgggccctggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatggg B*1530
(SEQ ID NO: 1254)
gaggtatttctacaccgccatgtcccggcccggccgcggggagccccgcttcatcgcagtgggctacgtggacgacaccc agttcgtgaggttcgacagcgacgccgcgagtccgaggatggcgcccgggcgccatggatagagcaggaggggccggag tattgggaccggggagacacagatctCcaagaccaacacacagacttaccgagagagcctgcggaacctgcgcggctacta caaccagagcgaggccgggtctcacaccctccagaggatgtacggctgcgacgtggggccggacgggcgcctcctccgcg ggcatAaccagtacgcctacgacggcaaggattacatcgccctgaacgaggacctgagctcctggaccgcGgcggacacg gcggctcagatcacccagcgcaagtgggaggcggcccgtgaggcggagcagTggagagcctacctggagggccTgtgcgt ggagtggctccgcagatacctggagaacgggaaggagacgctgcagcgc B*1531
(SEQ ID NO: 1255)
gaggtatttctacaccgccatgtcccggcccggccgcggggagccccgcttcatcgcagtgggctacgtggacgacaccc agttcgtgaggttcgacagcgacgccgcgagtccgaggatggCgccccgggcgccatggatagagcaggaggggccggag tattgggaccggaacacacagatctccaagaccaacacacagacttaccgagagagcctgcggaacctgcgcggctacta caaccagagcgaggccgggtctcacaccctccagagGatgtacggctgcgacgtggggccggacgggcgcctcctccgcg ggTatgaccagtCcgcctacgacggcaaggattacatcgccctgaacgaggacctgagctcctggaccgcggcggacacg gcggctcagatcacccagcgcaagtgggaggcggcccgtgTggcggagcagcTgagagcctacctggagggccTgtgcgt ggagtggctccgcagatacctggagaacgggaaggagacgctgcagcgcgcGg

B*1532

(SEQ ID NO: 1256)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggaccgggagacacagatctccaagaccaacacacagacttaccgagagagcctgcggaacc tgcgcggctactacaaccagagcgaggcccgggtctcacaccctccagaggatgtCtggctgcgacgtggggccggacggg cgcctcctccgcgggcatgaccagtccgcctacgacggcaaggattacatcgccctgaacgaggacctgagctcctggac cgcggcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcgg

B*1533

(SEQ ID NO: 1257)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggaccgggagacacagatctccaagaccaacacacagacttaccgagagagcctgcggaacc tgcgcggctactacaaccagagcgaggcccgggtctcacaccctccagaggatgtacggctgcgacgtggggccggacggg cgcctcctccgcgggcatgaccagtccgcctacgacggcaaggattacatcgccctgaacgaggacctgcgctcctggac cgccgcggacaAggcggctcagatcacccagcgcaagtgggaggcggcccgtgaggcggagcagtggagagcctacctgg agggcctgtgcgtggagtggctccgcagatacctggagaacgggaaggagacgctgcagcgcgcgg

B*1534

(SEQ ID NO: 1258)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggaccgggagacacagatctCcaagaccaacacacagacttaccgagagagcctgcggaacc tgcgcggctactacaaccagagcgaggcccgggtctcacaccctccagaggatgtacggctgcgacCtggggccggacggg cgcctcctccgcgggcatgaccagtCcgcctacgacggcaaggattacatcgccctgaacgaggacctgagctcctggac cgcGgcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcGg

B*1535

(SEQ ID NO: 1259)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggaccgggagacacagatctccaagaccaacacacagacttaccgagagagcctgcggaacc tgcgcggctactacaaccagagcgaggcccgggtctcacaccctccagaCGatgtacggctgcgacgtggggccggacggg cgcctcctccgcgggcatgaccagtCcgcctacgacggcaaggattacatcgccctgaacgaggacctgagctcctggac cgcGgcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcGg

B*1536

(SEQ ID NO: 1260)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggaccgggagacacagatctccaagaccaacacacagacttaccgagagaacctgcgCaccg cgctccgctactacaaccagagcgaggcccgggtctcacatcatccagaggatgtatggctgcgacgtggggccggacggg cgcctcctccgcgggTatgaccagtCcgcctacgacggcaaggattacatcgccctgaacgaggacctgagctcctggac cgcggcggacacggcggctcagatcacccagcgcaagtgggaggcggcccgtgaggcggagcagcTgagagcctacctgg agggcCTgtgcgtggagtggctccgcagatacctggagaacgggaaggagacgctgCagcgcgcGg

B*1537

(SEQ ID NO: 1261)

gctcccactccatgaggtatttctacaccgccatgtcccggcccggccgcggggagccccgcttcatctcagtgggctac gtggacgacacGcagttcgtgaggttcgacagcgacgccgcgagtccgagagaggagccgcgggcgccgtggatagagca ggaggggccggagtattgggaccggaacacacagatctGcaagaccaacacacagactTaccgagagagcctgcggaacc tgcgcggctactacaaccagagcgaggccgggtctcacaccctccagaggatgtacggctgcgacgtggggccggacggg cgcctcctccgcgggcatgaccagtacgcctacgacggcaaggattacatcgccctgaacgaggacctgAgctcctggac cgcggcggacacggcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*1538

(SEQ ID NO: 1262)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggaccgggagacacagatctccaagaccaacacacagacttaccgagagagcctgcggaacc tgcgcggctactacaaccagagcgaggccgggtctcacaccctccagaggatgtacggctgcgacgtggggccggacggg cgcctcctccgcgggcatgaccagtccgcctacgacggcaaggattacatcgccctgaacgaggacctgagctcctggac cgcggcggacacggcggctcagatcacccagcgcaagtgggaggcggcccgtgaggcggagcagTggagagcctacctgg agggcctgtgcgtggagtggctccgcagaCacctggagaacgggaaggagacgctgcagcgcgcGg

B*1539

(SEQ ID NO: 1263)

gctcccactccatgaggtatttctacaccgccatgtcccggcccggccgcggggagccccgcttcatcGcagtgggctac gtggacgacacccagttcgtgaggttcgacagcgacgccgcgagtccgaggatgCgccccgggcgccatggatagagca ggaggggccggagtattgggaccgggaGacacagatctCcaagaccaacAcacagacttaccgagagagcctgcggaacc tgcgcggctactacaaccagagcgaggccgggtctcacaccctccagagGatgtacggctgcgacgtggggccggacggg cgcctcctccgcgggcatgaccagtCcgcctacgacggcaaggattacatcgccctgaacgaggacctgagctcctggac cgcggcggacacggcggctcagatcacccagcgcaagtgggaggcggcccgtgaggcggagcagcTgagagcctacctgg agggccTgtgcgtggagtggctccgcagatacctggagaacgggaaggagacgctgcagcgcgcGg

B*1540

(SEQ ID NO: 1264)

gctcccactccatgaggtatttctacaccgccatgtcccggcccggccgcggggagccccgcttcatcGcagtgggctac gtggacgacacccagttcgtgaggttcgacagcgacgccgcgagtccgaggatggCgccccgggcgccatggatagagca ggaggggccggagtattgggaccgggaGacacagatctCcaagaccaacAcacagacttaccgagagagcctgcggaacc tgcgcggctactacaaccagagcgaggccgggtctcacaccctccagagGatgtacggctgcgacgtggggccggacggg cgcctcctccgcgggcatgaccagtCcgcctacgacggcaaggattacatcgccctgaacgaggacctgagctcctggac cgcggcggacacggcggctcagatcacccagcgcaagtgggaggcggcccgtgaggcggagcagcTgagagcctacctgg agggcgagtgcgtggagtggctccgcagatacctggagaacgggaaggagacgctgcagcgcgcGg

B*1542

(SEQ ID NO: 1265)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggaccgggagacacagatctCcaagaccaacacacagactTaccgagagagcctgcggaacc tgcgcggctactacaaccagagcgaggccgggtctcacacttggcagaCgatgtaTggctgcgacCtggggccggacggg cgcctcctccgcgggcataaccagttAgcctacgacggcaaggattacatcgccctgaacgaggacctgagctcctggac cgcggcggacaccgcggctcagatcacccagcgcaagtgggaggcggcccgtgaggcggagcagctgagagcctacctgg agggcaCgtgcgtggagtggctccgcagatacctggagaacgggaaggagacgctgcagcgcgcGg -continued

B*1543

(SEQ ID NO: 1266)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggaccgggagacacagatctccaagaccaacacacagacttaccgagagGacctgcggaccc tgctccgctactacaaccagagcgaggccgggtctcacaccctccagaggatgtacggctgcgacgtggggccggacggg cgcctcctccgcgggcatgaccagtccgcctacgacggcaaggattacatcgccctgaacgaggacctgagctcctggac cgcggcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcGg

B*1544

(SEQ ID NO: 1267)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggaccgggaacacacagatctGcaagaccaacacacagacttaccgagagagcctgcggaacc tgcgcggctactacaaccagagcgaggccgggtctcacatcatccagaggatgtatggctgcgacgtggggccggacggg cgcctcctccgcgggtatgaccagtCcgcctacgacggcaaggattacatcgccctgaacgaggacctgagctcctggac cgcGgcggacacggcggctcagatcacccagcgcaagtgggaggcggcccgtgaggcggagcagcTgagagcctacctgg agggcaCgtgcgtggagtggctccgcagatacctggagaacgggaaggagacgctgcagcgcgcGg

B*1545

(SEQ ID NO: 1268)

gctcccactccatgaggtatttctacaccgccAtgtcccggcccggccgcggggagccccgcttcatcgcagtgggctac gtggacgacacccagttcgtgaggttcgacagcgacgccgcgagtccgaggatggcgccCcgggcgccAtggatagagca ggaggggccggagtattgggaccgggaGacacagatctCcaagaccaacacacagactTaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgagctcctggac cgcGgcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcGg

B*1546

(SEQ ID NO: 1269)

atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcGcagtgggctacgtggacg acacccagttcgtgaggttcgacagcgacgccAcgagtccgaggaaggagccgcgggcgccAtggatagagcaggagggg ccggagtattgggaccgggaGacacagatctCcaagaccaacacacagactTaccgagagagcctgcggaacctgcgcgg ctactacaaccagagcgaggccgggtctcacaccctccagaggatgtacggctgcgacgtggggccggacgggcgcctcc tccgcgggcatgaccagtCcgcctacgacggcaaggattacatcgccctgaacgaggacctgagctcctggaccgcggcg gacacggcggctcagatcacccagcgcaagtgggaggcggcccgtgaggcggagcagTggagagcctacctggagggccT gtgcgtggagtggctccgcagatacctggagaacgggaaggagacgctgcagcgcgcGg

B*1547

(SEQ ID NO: 1270)

gctcccactccatgaggtatttctacaccgccatgtcccggcccggccgcggggagccccgcttcatctcagtgggctac gtggacgacacGcagttcgtgaggttcgacagcgacgccgcgagtccgagagaggagccgcgggcgccgtggatagagca ggaggggccggagtattgggaccgggaGacacagatctCcaagaccaacAcacagactTaccgagagagcctgcggaacc tgcgcggctactacaaccagagcgaggccgggtctcacaccctccagagGatgtacggctgcgacgtggggccggacggg cgcctcctccgcgggcatgaccagtCcgcctacgacggcaaggattacatcgccctgaacgaggacctgAgctcctggac

B*1548

(SEQ ID NO: 1271)

gctcccactccatgaggtatttctacaccgccatgtcccggcccggccgcggggagccccgcttcatcgcagtgggctac
gtggacgacacccagttcgtgaggttcgacagcgacgccgcgagtccgaggatggcgccccgggcgccatggatagagca
ggaggggccggagtattgggaccgggagacacagatctCcaagaccaacacacagacttaccgagagagcctgcggaacc
tgcgcggctactacaaccagagcgaggccgggtctcacaccctccagaggatgtacggctgcgacgtggggccggacggg
cgcctcctccgcgggcatAaccagtacgcctacgacggcaaggattacatcgccctgaacgaggacctgagctcctggac
cgcggcggacaccgcggctcagatcacccagcgcaagtgggaggcggcccgtgtggcggagcagctgagaAcctacctgg
agggcCTgtgcgtggagtggctccgcagatacctggagaacgggaaggagacgctgcagcgcgcGg

B*1549

(SEQ ID NO: 1272)

gctcccactccatgaggtatttctacaccgccatgtcccggcccggccgcggggagccccgcttcatctcagtgggctac
gtggacgacacgcagttcgtgaggttcgacagcgacgccgcgagtccgagagaggagccgcgggcgccgtggatagagca
ggaggggccggagtattgggaccgggagacacagatctccaagaccaacacacGgacttaccgagagagcctgcggaacc
tgcgcggctactacaaccagagcgaggccgggtctcacaccctccagaggatgtacggctgcgacgtggggccggacggg
cgcctcctccgcgggcatgaccagtccgcctacgacggcaaggattacatcgccctgaacgaggacctgagctcctggac
cgcggcggacacggcggctcagatcacccagcgcaagtgggaggcggcccgtgaggcggagcagcggagagcctacctgg
agggcgagtgcgtggagtggctccgcagatacctggagaacgggaaggagacgctgcagcgcgcgg

B*1550

(SEQ ID NO: 1273)

gctcccactccatgaggtatttctacaccgccatgtcccggcccggccgcggggagccccgcttcatcgcagtgggctac
gtggacgacacccagttcgtgaggttcgacagcgacgccgcgagtccgaggatggcgccccgggcgccatggatagagca
ggaggggccggagtattgggaccgggagacacagatctccaagaccaacacacagacttaccgagagagcctgcggaacc
tgcgcggctactacaaccagagcgaggccgggtctcacaccctccagaggatgtacggctgcgacgtggggccggacggg
cgcctcctccgcgggcatgaccagtCcgcctacgacggcaaggattacatcgccctgaacgaggacctgagctcctggac
cgcggcggacacggcggctcagatcacccagcgcaagtgggaggcggcccgtgaggcggagcagTggagagcctacctgg
agggcaCgtgcgtggagtggctccgcagatacctggagaacgggaaggagacgctgcagcgcgcGg

B*1551

(SEQ ID NO: 1274)

gctcccactccatgaggtatttctacaccgccatgtcccggcccggccgcggggagccccgcttcatctcagtgggctac
gtggacgacacgcagttcgtgaggttcgacagcgacgccgcgagtccgagagaggagccgcgggcgccgtggatagagca
ggaggggccggagtattgggaccggaacacacagatctGcaagaccaacacacagacttaccgagagagcctgcggaacc
tgcgcggctactacaaccagagcgaggccgggtctcacaccctccagaggatgtacggctgcgacgtggggccggacggg
cgcctcctccgcgggcatgaccagtCcgcctacgacggcaaggattacatcgccctgaacgaggacctgagctcctggac
cgcggcggacacggcggctcagatcacccagcgcaagtgggaggcggcccgtgTggcggagcaggaCagagcctacctgg
agggccTgtgcgtggagtggctccgcagatacctggagaacgggaaggaGacgctgCagcgcgcGg

B*1552

(SEQ ID NO: 1275)

atgcgggtcacggcgccccgaaccgtcctcctgctgctctcgggAgccctggccctgaccgagacctgggccggctccca
ctccatgaggtatttctacaccgccatgtcccggcccggccgcggggagccccgcttcatctcagtgggctacgtggacg
acacgcagttcgtgaggttcgacagcgacgccgcgagtccgagagaggagccgcgggcgccgtggatagagcaggagggg
ccggagtattgggaccggaacacacagatctGcaagaccaacacacagacttaccgagagagcctgcggaacctgcgcgg
ctactacaaccagagcgaggccgggtctcacaccctccagagGatgtacggctgcgacgtggggccggacgggcgcctcc

B*1553 (SEQ ID NO: 1276)

atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcaccgtgggctacgtggacg acacgcTgttcgtgaggttcgacagcgacgccAcgagtccgaggaaggagccgcgggcgccAtggatagagcaggagggg ccggagtattgggaccgggaGacacagatctCcaagaccaacacacagactTaccgagagagcctgcggaacctgcgcgg ctactacaaccagagcgaggccgggtctcacaccctccagaggatgtacggctgcgacgtggggccggacgggcgcctcc tccgcgggcatgaccagtCcgcctacgacggcaaggattacatcgccctgaacgaggacctgagctcctggaccgcggcg gacacggcggctcagatcacccagcgcaagtgggaggcggcccgtgaggcggagcagTgagagcctacctggagggccT gtgcgtggagtggctccgcagatacctggagaacgggaaggagacgctgcagcgcgcGg

B*1554 (SEQ ID NO: 1277)

atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatctcagtgggctacgtggacg acacGcagttcgtgaggttcgacagcgacgccgcgagtccgagagaggagccgcgggcgccgtggatagagcaggagggg ccggagtattgggaccgggaGacacagatctCcaagaccaacacacagactTaccgagagagcctgcggaacctgcgcgg ctactacaaccagagcgaggccgggtctcacaccctccagaggatgtacggctgcgacgtggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagTgagagcctacctggagggcct gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*1555 (SEQ ID NO: 1278)

atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgcccgggcgccatggatagagcaggagggg ccggagtattgggaccggaacacacagatctccaagaccaacacacagacttaccgagagagcctgcggaacctgcgcgg ctactacaaccagagcgaggccgggtctcacaccctccagagcatgtacggctgcgacgtggggccggacgggcgcctcc tccgcgggtatgaccagtccgcctacgacggcaaggattacatcgccctgaacgaggacctgagctcctggaccgcggcg gacacggcggctcagatcacccagcgcaagtgggaggcggcccgtgTggcggagcagcTgagagcctacctggagggcct gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*1556

(SEQ ID NO: 1279)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggacccgggaGacacagatctTcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatgaccagtCcgcctacgacggcaaggattacatcgccctgaacgaggacctgagctcctggac cgcGgcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcGg

B*1557

(SEQ ID NO: 1280)

gggtcacggcgccccgaaccgtcctcctgctgctctcggggagccctggccctgaccgagacctgggccggctcccactcc atgaggtatttctacaccgccatgtcccggcccggccgcggggagccccgcttcatcgcagtgggctacgtggacgacac ccagttcgtgaggttcgacagcgacgccgcgagtccgaggatggcgccccgggcgccatggatagagcaggaggggccgg agtattgggaccgggagacacagatctccaagaccaacacacagacttaccgagTgaAcctgcggaacctgcgcggctac tacaaccagagcgaggccgggtctcacaccctccagaggatgtacggctgcgacgtggggccggacgggcgcctcctccg cgggcatgaccagtccgcctacgacggcaaggattacatcgccctgaacgaggacctgagctcctggaccgcggcggaca cggcggctcagatcacccagcgcaagtgggaggcggcccgtgaggcggagcagtggagagcctacctggagggccTgtgc gtggagtggctccgcagatacctggagaacgggaaggagacgctgCagcgcgcGg

B*1558

(SEQ ID NO: 1281)

atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgccccgggcgccatggatagagcaggagggg ccggagtattgggaccgggagacacagatctccaagaccaacacacagacttaccgagagagcctgcggaacctgcgcgg ctactacaaccagagcgaggccgggtctcacaccctccagaggatgtacggctgcgacgtggggccggacgggcgcctcc tccgcgggcataaccagtTcgcctacgacggcaaggattacatcgccctgaacgaggacctgagctcctggaccgcggcg gacacggcggctcagatcacccagcgcaagtgggaggcggcccgtgaggcggagcagTggagagcctacctggagggccT gtgcgtggagtggctccgcagatacctggagaacgggaaggagacgctgcagcgcgcGg

B*1560

(SEQ ID NO: 1282)

gctcccactccatgaggtatttctacaccgccatgtcccggcccggccgcggggagccccgcttcatcgcagtgggctac gtggacgacacccagttcgtgaggttcAacagcgacgccgcgagtccgaggatggcgccccgggcgccatggatagagca ggaggggccggagtattgggaccgggagacacagatctccaagaccaacacacagacttaccgagagagcctgcggaacc tgcgcggctactacaaccagagcgaggccgggtctcacaccctccagaggatgtacggctgcgacgtggggccggacggg cgcctcctccgcgggcatgaccagtccgcctacgacggcaaggattacatcgccctgaacgaggacctgagctcctggac cgcggcggacacggcggctcagatcacccagcgcaagtgggaggcggcccgtgaggcggagcagtggagagcctacctgg agggcctgtgcgtggagtggctccgcagatacctggagaacgggaaggagacgctgcagcgcgcgg

B*1561

(SEQ ID NO: 1283)

gctcccactccatgaggtatttctacaccgccatgtcccggcccggccgcggggagccccgcttcatctcagtgggctac gtggacgacacGcagttcgtgaggttcgacagcgacgccgcgagtccgagagaggagccgcgggcgccgtggatagagca ggaggggccggagtattgggaccgggaGacacagatctCcaagaccaacAcacagactgaccgagagagcctgcggaacc tgcgcggctactacaaccagagcgaggccgggtctcacaccctccagagGatgtacggctgcgacgtggggccggacggg cgcctcctccgcgggcatgaccagtCcgcctacgacggcaaggattacatcgccctgaacgaggacctgAgctcctggac -continued cgcggcggacacggcggctcagatcacccagcgcaagtgggaggcggcccgtgaggcggagcagcTgagagcctacctgg agggccTgtgcgtggagtggctccgcagatacctggagaacgggaaggagacgctgcagcgcgcGg

B*1562

(SEQ ID NO: 1284)

gctcccactccatgaggtatttctacaccgccatgtcccggcccggccgcggggagccccgcttcatctcagtgggctac gtggacgacacGcagttcgtgaggttcgacagcgacgccgcgagtccgagagaggagccgcgggcgccgtggatagagca ggaggggccggagtattgggacccgggaGacacagatctCcaagaccaacAcacagactTaccgagagagcctgcggaacc tgcgcggctactacaaccagagcgaggccgggtctcacatcAtccagaggatgtaTggctgcgacCtggggccCgacggg cgcctcctccgcgggcatgaccagtCcgcctacgacggcaaggattacatcgccctgaacgaggacctgAgctcctggac cgcGgcggacacggcggctcagatcacccagcgcaagtgggaggcggcccgtgaggcggagcagcTgagagcctacctgg agggccTgtgcgtggagtggctccgcagatacctggagaacgggaaggagacgctgCagcgcgcGg

B*1563

(SEQ ID NO: 1285)

gctcccactccatgaggtatttctacaccgccAtgtcccggcccggccgcggggagccccgcttcatcgcagtgggctac gtggacgacacccagttcgtgaggttcgacagcgacgccgcgagtccgaggatggcgccCcgggcgccAtggatagagca ggaggggccggagtattgggacccgggaGacacagatctCcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatgaccagtacgcctacgacggcaaggattacatcgccctgaacgaggacctgagctcctggac cgcGgcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcGg

B*1564

(SEQ ID NO: 1286)

gctcccactccatgaggtatttctacaccgccatgtcccggcccggccgcggggagccccgcttcatctcagtgggctac gtggacgacacGcagttcgtgaggttcgacagcgacgccgcgagtccgagagaggagccgcgggcgccgtggatagagca ggaggggccggagtattgggaccggaacacacagatctCcaagaccaacAcacagactTaccgagagagcctgcggaacc tgcgcggctactacaaccagagcgaggccgggtctcacaccctccagagGatgtacggctgcgacgtggggccggacggg cgcctcctccgcgggcatgaccagtCcgcctacgacggcaaggattacatcgccctgaacgaggacctgAgctcctggac cgcggcggacacggcggctcagatcacccagcgcaagtgggaggcggcccgtgaggcggagcagcTgagagcctacctgg agggccTgtgcgtggagtggctccgcagatacctggagaacgggaaggagacgctgcagcgcgcGg

B*1565

(SEQ ID NO: 1287)

gctcccactccatgaggtatttctacaccgccAtgtcccggcccggccgcggggagccccgcttcatcGcagtgggctac gtggacgacacccagttcgtgaggttcgacagcgacgccgcgagtccgaggatggCgccccgggcgccatggatagagca ggaggggccggagtattgggacccgggaGacacagatctCcaagaccaacAcacagactTaccgagagagcctgcggaacc tgcgcggctactacaaccagagcgaggccgggtctcacaccctccagagGatgtacggctgcgacgtggggccggacggg cgcctcctccgcgggcatgaccagtCcgcctacgacggcaaggattacatcgccctgaacgaggacctgagctcctggac cgcGgcggacacggcggctcagatcacccagcgcaagtgggaggcggcccgtgaggcggagcagcggagagcctacctgg agggccTgtgcgtggagtggctccgcagatacctggagaacgggaaggagacgctgcagcgcgcGg

B*1566

(SEQ ID NO: 1288)

atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgccccgggcgccatggatagagcaggaggg ccggagtattgggacccgggagacacagatctGcaagaccaacacacagactTaccgagagagcctgcggaacctgcgcgg ctactacaaccagagcgaggccgggtctcacaccctccagaggatgtacggctgcgacgtggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagTggagagcctacctggagggcct gtgcgtggagtggctccgcagatacctggagaacgggaaggagacgctgcagcgcgcggacccccaaagacacatgtga cccaccaccccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga B*1567
(SEQ ID NO: 1289)
gctcccacttcatgaggtatttctacaccgccatgtcccggcccggccgcggggagcccgcttcatcgcagtgggctac gtggacgacacgcagttcgtgaggttcgacagcgacgccgcgagtccgaggatggcgccccgggcgccatggatagagca ggaggggccggagtattgggaccgggagacacggaacatgaaggcctccgcgcagacttaccgagagaacctgcgcgatcg cgctccgctactacaaccagagcgaggccgggtctcacacttggcagaggatgtatggctgcgacctggggccggacggg cgcctcctccgcgggcatgaccagtccgcctacgacggcaaggattacatcgccctgaacgaggacctgagctcctggac cgcggcggacacggcggctcagatcacccagcAcaagtgggaggcggcccgtgaggcggagcagctgagagcctacctgg agggcctgtgcgtggagtggctccgcagatacctggagaacgggaaggagacgctgcagcgcgcgg B*1568
(SEQ ID NO: 1290)
gctcccactccatgaggtatttctacacctccgtgtcccggcccggccgcggggagcccgcttcatctcagtgggctac gtggacgacacccagttcgtgaggttcgacagcgacgccgcgagtccgagagaggagccgcgggcgccgtggatagagca ggaggggccggagtattgggaccgggaGacacagatctCcaagaccaacacacagactTaccgagagagcctgcgcgaacc tgcgcggctactacaaccagagcgaggccgggtctcacaccctccagagcatgtacggctgcgacgtggggccggacggg cgcctcctccgcgggcatgaccagtccgcctacgacggcaaggattacatcgccctgaacgaggacctgagctcctggac cgcggcggacacggcggctcagatcacccagcgcaagtgggaggcggcccgtgaggcggagcagTggagagcctacctgg agggcctgtgcgtggagtggctccgcagatacctggagaacgggaaggagacgctgcagcgcgcggacccccaaagaca catgtgacccaccaccccatctctgaccatgaggccaccctgaggtgctgggccctgggcttctaccctgcggagatcac actgacctggcagcgggatggcgaggaccaaactcaggacacCgagcttgtggagaccagaccagcaggagatagaacct tccagaagtgggcagctgtggtggtgccttctggagaagagcagagatacacatgccatgtacagcatgaggggctgccg aagcccctcaccctgagatggg B*1569
(SEQ ID NO: 1291)
gctcccactccatgaggtatttctacaccgccatgtcccggcccggccgcggggagcccgcttcatctcagtgggctac gtggacgacacgcagttcgtgaggttcgacagcgacgccgcgagtccgagagaggagccgcgggcgccgtggatagagca ggaggggccggagtattgggaccgggagacacagatctCcaagaccaacacacagacttaccgagagagcctgcgcgaacc tgcgcggctactacaaccagagcgaggccgggtctcacaccctccagaggatgtacggctgcgacgtggggccggacggg cgcctcctccgcgggcatgaccagtCcgcctacgacggcaaggattacatcgccctgaacgaggacctgagctcctggac cgcggcggacacggcggctcagatcacccagcgcaagtgggaggcggcccgtgaggcggagcagcTgagaAcctacctgg agggcaCgtgcgtggagtggctccgcagatacctggagaacgggaaggagacgctgcagcgcgcGg B*1570
(SEQ ID NO: 1292)
gctcccactccatgaggtatttctacaccgccAtgtcccggcccggccgcggggagcccgcttcatcgcagtgggctac gtggacgacacccagttcgtgaggttcgacagcgacgccgcgagtccgaggatggcgccCcgggcgccAtggatagagca ggaggggccggagtattgggaccgggaGacacagatctCcaagaccaacAcacagactgaccgagagagcctgcgcgaacc tgcgcggctactacaaccagagcgaggccgggtctcacaccctccagagGatgtacggctgcgacgtggggccggacggg -continued cgcctcctccgcgggcatgaccagtCcgcctacgacggcaaggattacatcgccctgaacgaggacctgagctcctggac cgcGgcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcGg B*1571
(SEQ ID NO: 1293)
gctcccactccatgaggtatttcCacacctccgtgtcccggcccggccgcggggagccccgcttcatcgcagtgggctac gtggacgacacccagttcgtgaggttcgacagcgacgccgcgagtccgaggatggcgccccgggcgccAtggatagagca ggaggggccggagtattgggaccgggaGacacagatctCcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatgaccagtccgcctacgacggcaaggattacatcgccctgaacgaggacctgagctcctggac cgcggcggacacggcggctcagatcacccagcgcaagtgggaggcggcccgtgaggcggagcagTggagagcctacctgg agggcctgtgcgtggagtggctccgcagatacctggagaacgggaaggagacgctgcagcgcgcggaccccccaaagaca catgtgacccaccaccccatctctgaccatgaggccaccctgaggtgctgggccctgggcttctaccctgcggagatcac actgacctggcagcgggatggcgaggaccaaactcaggacacCgagcttgtggagaccagaccagcaggagatagaacct tccagaagtgggcagctgtggtggtgccttctggagaagagcagagatacacatgccatgtacagcatgaggggctgccg aagcccctcaccctgagatggg B*1572
(SEQ ID NO: 1294)
gctcccactccatgaggtatttctacaccgccatgtcccggcccggccgcggggagccccgcttcatctcagtgggctac gtggacgacacGcagttcgtgaggttcgacagcgacgccgcgagtccgagagaggagccgcgggcgccgtggatagagca ggaggggccggagtattgggaccggaacacacagatctGcaagaccaacacacagacttaccgagagagcctgcggaacc tgcgcggctactacaaccagagcgaggccgggtctcacaccctccagaggatgtacggctgcgacgtggggccggacggg cgcctcctccgcgggcatgaccagtCcgcctacgacggcaaggattacatcgccctgaacgaggacctgcgctcctggac cgcggcggacacggcggctcagatcacccagcgcaagtgggaggcggcccgtgaggcggagcagcTgagagcctacctgg agggccTgtgcgtggagtggctccgcagatacctggagaacgggaaggagacgctgcagcgcgcggaccccccaaagaca caTgtgacccaccaccccatctctgaccatgaggccaccctgaggtgctgggccctgggcttctaccctgcggagatcac actgacctggcagcgggatggcgaggaccaaactcaggacacCgagcttgtggagaccagaccagcaggagatagaacct tccagaagtgggcagctgtggtggtgccttctggagaagagcagagatacacatgccatgtacagcatgaggggctgccg aagcccctcaccctgagatggg B*1573
(SEQ ID NO: 1295)
gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggaccgggagacacagatctccaagaccaacacacagacttaccgagagagcctgcggaacc tgcgcggctactacaaccagagcgaggccgggtctcacaccctccagaggatgtacggctgcgacgtggggccggacggg cgcctcctccgcgggcataaccagttAgcctacgacggcaaggattacatcgccctgaacgaggacctgagctcctggac cgcggcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcGg B*1574
(SEQ ID NO: 1296)
gctcccactccatgaggtatttctacaccgccatgtcccggcccggccgcggggagccccgcttcatctcagtgggctac gtggacgacacGcagttcgtgaggttcgacagcgacgccgcgagtccgagagaggagccgcgggcgccgtggatagagca ggaggggccggagtattgggaccgggagacacagatctccaagaTcaacacacagacttaccgagagagcctgcggaacc tgcgcggctactacaaccagagcgaggccgggtctcacaccctccagaggatgtacggctgcgacgtggggccggacggg cgcctcctccgcgggcatgaccagtccgcctacgacggcaaggattacatcgccctgaacgaggacctgagctcctggac

**B*1575**

(SEQ ID NO: 1297)

```
cgcggcggacacggcggctcagatcacccagcgcaagtgggaggcggcccgtgaggcggagcagctgagagcctacctgg
agggcctgtgcgtggagtggctccgcagatacctggagaacgggaaggagacgctgcagcgcgcgg
```

**B*1575**

(SEQ ID NO: 1297)

```
gctcccactccatgaggtatttctacaccgccatgtcccggcccggccgcggggagccccgcttcatcgcagtgggctac
gtggacgacacccagttcgtgaggttcgacagcgacgccgcgagtccgaggatggcgccccgggcgccatggatagagca
ggaggggccggagtattgggaccgggagacacagatctccaagaccaacacacagacttaccgagagagcctgcggaacc
tgcgcggctactacaaccagagcgaggccgggtctcacaccctccagaggatgtacggctgcgacgtggggccggacggg
cgcctcctccgcgggcatgaccagtccgcctacgacggcaaggattacatcgccctgaacgaggacctgagctcctggac
cgcggcggacacggcggctcagatcacccagcgcaagtgggaggcggcccgtCaggcggagcagtggagagcctacctgg
agggcctgtgcgtggagtggctccgcagatacctggagaacgggaaggagacgctgcagcgcgcgg
```

**B*180101**

(SEQ ID NO: 1298)

```
atgcgggtcacggcgccccgaaccctcctcctgctgctctgggggcagtggccctgaccgagacctgggctggctccca
ctccatgaggtatttccacacctccgtgtcccggcccggccgcggggagccccgcttcatctcagtgggctacgtggacg
gcacccagttcgtgaggttcgacagcgacgccgcgagtccgaggacggagccccgggcgccgtggatagagcaAgagggg
ccggagtattgggaccggaacacacagatctccaagaccaacacacagactTaccgagagagcctgcggaacctgcgcgg
ctactacaaccagagcgaggccgggtctcacaccctccagagGatgtacggctgcgacgtggggccggacgggcgcctcc
tccgcgggcatgaccagtccgcctacgacggcaaggattacatcgccctgaacgaggacctgagctcctggaccgcggcg
gacaccgcggctcagatcacccagcgcaagtgggaggcggcccgtgtggcggagcagctgagagcctacctggagggcac
gtgcgtggagtggctccgcagacacctggagaacgggaaggagacgctgcagcgcgcggacccccaaagacacatgtga
cccaccaccccatctctgaccatgaggccaccctgaggtgctgggccctgggcttctaccctgcggagatcacactgacc
tggcagcgggatggcgaggaccaaactcaggacaccgagcttgtggagaccagaccagcaggagatagaaccttccagaa
gtgggcagctgtggtggtgccttctggagaagagcagagatacacatgccatgtacagcatgaggggctgccgaagcccc
tcaccctgagatgggagccatcttcccagtccaccatccccatcgtgggcattgttgctggcctggctgtccta...gca
gttgtggtcatcggagctgtggtcgctactgtgatgtgtaggaggaagagCtcaggtgga
```

**B*180102**

(SEQ ID NO: 1299)

```
gctcccactccatgaggtatttccacacctccgtgtcccggcccggccgcggggagccccgcttcatctcagtgggctac
gtggacggcacccagttcgtgaggttcgacagcgacgccgcgagtccgaggacggagccccgggcgccgtggatagagca
agaggggccggagtattgggaccggaacacacagatctccaagaccaacacacagacttacAgagagagcctgcggaacc
tgcgcggctactacaaccagagcgaggccgggtctcacaccctccagaggatgtacggctgcgacgtggggccggacggg
cgcctcctccgcgggcatgaccagtccgcctacgacggcaaggattacatcgccctgaacgaggacctgagctcctggac
cgcggcggacaccgcggctcagatcacccagcgcaagtgggaggcggcccgtgtggcggagcagctgagagcctacctgg
agggcacgtgcgtggagtggctccgcagacacctggagaacgggaaggagacgctgcagcgcgcgg
```

**B*1802**

(SEQ ID NO: 1300)

```
atgcgggtcacggcgccccgaaccctcctcctgctgctctgggggcagtggccctgaccgagacctgggctggctccca
ctccatgaggtatttccacacctccgtgtcccggcccggccgcggggagccccgcttcatctcagtgggctacgtggacg
gcacccagttcgtgaggttcgacagcgacgccgcgagtccgaggacggagccccgggcgccgtggatagagcaAgagggg
ccggagtattgggaccggaacacacagatctccaagaccaacacacagacttaccgagagagcctgcggaacctgcgcgg
ctactacaaccagagcgaggccgggtctcacaccctccagaatatgtaTggctgcgacgtggggccggacgggcgcctcc
tccgcgggcatgaccagtccgcctacgacggcaaggattacatcgccctgaacgaggacctgagctcctggaccgcggcg
gacaccgcggctcagatcacccagcgcaagtgggaggcggcccgtgtggcggagcagctgagagcctacctggagggcac
```

```
gtgcgtggagtggctccgcagacacctggagaacgggaaggagacgctgcagcgcgcggacccccaaagacacatgtga cccaccacccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgagggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga
```

B*1803                                              (SEQ ID NO: 1301)
```
atgcgggtcacggcgccccgaaccctcctcctgctgctctgggggcagtggccctgaccgagacctgggctggctccca ctccatgaggtatttccacacctccgtgtcccggcccggccgcggggagccccgcttcatctcagtgggctacgtggacg gcacccagttcgtgaggttcgacagcgacgccgcgagtccgaggacggagccccgggcgccgtggatagagcaAgagggg ccggagtattgggaccggaacacacagatctccaagaccaacacacagactgaccgagagagcctgcggaacctgcgcgg ctactacaaccagagcgaggccgggtctcacaccctccagagGatgtacggctgcgacgtggggccggacgggcgcctcc tccgcgggcatgaccagtccgcctacgacggcaaggattacatcgccctgaacgaggacctgagctcctggaccgcggcg gacaccgcggctcagatcacccagcgcaagtgggaggcggcccgtgtggcggagcagctgagagcctacctggagggcac gtgcgtggagtggctccgcagacacctggagaacgggaaggagacgctgcagcgcgcggacccccaaagacacatgtga cccaccacccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgagggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga
```

B*1804                                              (SEQ ID NO: 1302)
```
gctcccactccatgaggtatttctacaccgccatgtcccggcccggccgcggggagccccgcttcattGcagtgggctac gtggacggcacccagttcgtgaggttcgacagcgacgccgcgagtccgaggacggagccccgggcgccgtggatagagca AgaggggccggagtattgggaccggaacacacagatctCcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatgaccagtccgcctacgacggcaaggattacatcgccctgaacgaggacctgagctcctggac cgcggcggacaccgcggctcagatcacccagcgcaagtgggaggcggcccgtgTggcggagcagcTgagagcctacctgg agggcacgtgcgtggagtggctccgcagaCacctggagaacgggaaggagacgctgcagcgcgcgg
```

B*1805                                              (SEQ ID NO: 1303)
```
gctcccactccatgaggtatttccacacctccgtgtcccggcccggccgcggggagccccgcttcatctcagtgggctac gtggacggcacccagttcgtgaggttcgacagcgacgccgcgagtccgaggacggagccccgggcgccgtggatagagca agaggggccggagtattgggaccggaacacacagatctccaagaccaacacacagacttaccgagagagcctgcggaacc tgcgcggctactacaaccagagcgaggccgggtctcacaccctccagaggatgtacggctgcgacgtggggccggacggg cgcctcctccgcgggcatgaccagtccgcctacgacggcaaggattacatcgccctgaaGgaggacctgagctcctggac cgcggcggacaccgcggctcagatcacccagcgcaagtgggaggcggcccgtgtggcggagcagctgagagcctacctgg agggcacgtgcgtggagtggctccgcagacacctggagaacgggaaggagacgctgcagcgcgcgg
```

B*1806                                              (SEQ ID NO: 1304)
```
atgcgggtcacggcgccccgaaccctcctcctgctgctctgggggcagtggccctgaccgagacctgggctggctccca ctccatgaggtatttccacacctccgtgtcccggcccggccgcggggagccccgcttcatctcagtgggctacgtggacg gcacccagttcgtgaggttcgacagcgacgccgcgagtccgaggacggagccccgggcgccgtggatagagcaagagggg ccggagtattgggaccggaacacacagatctccaagaccaacacacagacttaccgagTgagcctgcggaacctgcgcgg
```

-continued ctactacaaccagagcgaggccgggtctcacaccctccagaggatgtacggctgcgacgtggggccggacgggcgcctcc
tccgcgggcatgaccagtccgcctacgacggcaaggattacatcgccctgaacgaggacctgagctcctggaccgcggcg
gacaccgcggctcagatcacccagcgcaagtgggaggcggcccgtgtggcggagcagctgagagcctacctggagggcac
gtgcgtggagtggctccgcagaCacctggagaacgggaaggagacgctgcagcgcgcggaccccccaaagacacatgtga
cccaccaccccatctctgaccatgaggccaccctgaggtgctgggccctgggcttctaccctgcggagatcacactgacc
tggcagcgggatggcgaggaccaaactcaggacaccgagcttgtggagaccagaccagcaggagatagaaccttccagaa
gtgggcagctgtggtggtgccttctggagaagagcagagatacacatgccatgtacagcatgaggggctgccgaagcccc
tcaccctgagatgggagccatcttcccagtccaccatccccatcgtgggcattgttgctggcctggctgtccta...gca
gttgtggtcatcggagctgtggtcgctActgtgatgtgtaggaggaagagCtcaggtgga B*1807
(SEQ ID NO: 1305)
gctcccactccatgaggtatttccacacctccgtgtcccggcccggccgcggggagccccgcttcatctcagtgggctac
gtggacggcacccagttcgtgaggttcgacagcgacgccgcgagtccgaggacggagccccgggcgccgtggatagagca
AgaggggccggagtattgggaccggaacacacagatctTcaagaccaacacacagactTaccgagagagcctgcggaacc
tgcgcggctactacaaccagagcgaggccgggtctcacaccctccagagGatgtacggctgcgacgtggggccggacggg
cgcctcctccgcgggcatgaccagtccgcctacgacggcaaggattacatcgccctgaacgaggacctgagctcctggac
cgcggcggacaccgcggctcagatcacccagcgcaagtgggaggcggcccgtgTggcggagcagcTgagagcctacctgg
agggcacgtgcgtggagtggctccgcagaCacctggagaacgggaaggagacgctgcagcgcgcgg B*1808
(SEQ ID NO: 1306)
gctcccactccatgaggtatttccacacctccgtgtcccggcccggccgcggggagccccgcttcatctcagtgggctac
gtggacggcacccagttcgtgaggttcgacagcgacgccgcgagtccgaggacggagccccgggcgccgtggatagagca
agaggggccggagtattgggaccggaacacacagatctccaagaccaacacacagacttaccgagagagcctgcggaacc
tgcgcggctactacaaccagagcgaggccgggtctcacaccctccagaggatgtGcggctgcgacgtggggccggacggg
cgcctcctccgcgggcatgaccagtccgcctacgacggcaaggattacatcgccctgaacgaggacctgagctcctggac
cgcggcggacaccgcggctcagatcacccagcgcaagtgggaggcggcccgtgtggcggagcagctgagagcctacctgg
agggcacgtgcgtggagtggctccgcagacacctggagaacgggaaggagacgctgcagcgcgcgg B*1809
(SEQ ID NO: 1307)
gctcccactccatgaggtatttccacacctccgtgtcccggcccggccgcggggagccccgcttcatctcagtgggctac
gtggacggcacccagttcgtgaggttcgacagcgacgccgcgagtccgaggacggagccccgggcgccgtggatagagca
Agaggggccggagtattgggaccggaacacacagatctccaagaccaacacacagacttaccgagagaacctgcgcaccg
cgctcCgctactacaaccagagcgaggccgggtctcacaccctccagagGatgtacggctgcgacgtggggccggacggg
cgcctcctccgcgggcatgaccagtccgcctacgacggcaaggattacatcgccctgaacgaggacctgagctcctggac
cgcggcggacaccgcggctcagatcacccagcgcaagtgggaggcggcccgtgTggcggagcagcTgagagcctacctgg
agggcacgtgcgtggagtggctccgcagaCacctggagaacgggaaggagacgctgcagcgcgcgg B*1810
(SEQ ID NO: 1308)
gctcccactccatgaggtatttcCacacctccgtgtcccggcccggccgcggggagccccgcttcatctcagtgggctac
gtggacggcacccagttcgtgaggttcgacagcgacgccgcgagtccgaggacggagccccgggcgccgtggatagagca
AgaggggccggagtattgggaccggaacacacagatctCcaagaccaacacacagactTaccgagagagcctgcggaacc
tgcgcggctactacaaccagagcgaggccgggtctcacaccctccagagGatgtacggctgcgacgtggggccggacggg
cgcctcctccgcgggcatgaccagtccgcctacgacggcaaggattacatcgccctgaacgaggacctgagctcctggac cgcggcggacaccgcggctcagatcacccagcgcaagtgggaggcggcccgtgTggcggagcagcTgagagcctacctgg agggcgagtgcgtggagtggctccgcagatacctggagaacgggaaggagacgctgcagcgcgcgg

B*1811

(SEQ ID NO: 1309)

gctcccactccatgaggtatttcCacacctccgtgtcccggcccggccgcggggagccccgcttcatctcagtgggctac gtggacggcacccagttcgtgaggttcgacagcgacgccgcgagtccgaggacggagccccgggcgccgtggatagagca AgaggggccggagtattgggaccggaacacacagatctCcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatgaccagtccgcctacgacggcaaggattacatcgccctgaacgaggacctgagctcctggac cgcggcggacaccgcggctcagatcacccagcgcaagtgggaggcggcccgtgTggcggagcagcTgagagcctacctgg agggcaCgtgcgtggagtggctccgcagatacctggagaacgggaaggagacgctgcagcgcgcgg

B*1812

(SEQ ID NO: 1310)

gctcccactccatgaggtatttccacacctccgtgtcccggcccggccgcggggagccccgcttcatctcagtgggctac gtggacggcacccagttcgtgaggttcgacagcgacgccgcgagtccgaggacggagccccgggcgccgtggatagagca AgaggggccggagtattgggaccgggaGacacagatctCcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatgaccagtccgcctacgacggcaaggattacatcgccctgaacgaggacctgagctcctggac cgcggcggacaccgcggctcagatcacccagcgcaagtgggaggcggcccgtgTggcggagcagcTgagagcctacctgg agggcacgtgcgtggagtggctccgcagaCacctggagaacgggaaggagacgctgcagcgcgcgg

B*1813

(SEQ ID NO: 1311)

gctcccactccatgaggtatttcCacacctccgtgtcccggcccggccgcggggagccccgcttcatctcagtgggctac gtggacggcacccagttcgtgaggttcgacagcgacgccgcgagtccgaggacggagccccgggcgccgtggatagagca AgaggggccggagtattgggaccggaacacacagatctCcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatgaccagtccgcctacgacggcaaggattacatcgccctgaacgaggacctgagctcctggac cgcggcggacaccgcggctcagatcacccagcgcaagtgggaggcggcccgtgTggcggagcagcggagagcctacctgg agggcacgtgcgtggagtggctccgcagaCacctggagaacgggaaggagacgctgcagcgcgcgg

B*1814

(SEQ ID NO: 1312)

gctcccactccatgaggtatttcCacacctccgtgtcccggcccggccgcggggagccccgcttcatctcagtgggctac gtggacggcacccagttcgtgaggttcgacagcgacgccgcgagtccgaggacggagccccgggcgccgtggatagagca AgaggggccggagtattgggaccggaacacacagatctCcaagaccaacacacagactTaccgagagagcctgcggaacc tgcgcggctactacaaccagagcgaggccgggtctcacaccctccagagcatgtacggctgcgacgtggggccggacggg cgcctcctccgcgggcatgaccagtccgcctacgacggcaaggattacatcgccctgaacgaggacctgagctcctggac cgcggcggacaccgcggctcagatcacccagcgcaagtgggaggcggcccgtgTggcggagcagcTgagagcctacctgg agggcacgtgcgtggagtggctccgcagaCacctggagaacgggaaggagacgctgcagcgcgcgg

B*1815

(SEQ ID NO: 1313)

gctcccactccatgaggtatttcCacacctccgtgtcccggcccggccgcggggagccccgcttcatctcagtgggctac gtggacggcacccagttcgtgaggttcgacagcgacgccgcgagtccgaggacggagccccgggcgccgtggatagagca AgaggggccggagtattgggaccggaacacacagatctCcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatgaccagtccgcctacgacggcaaggattacatcgccctgaacgaggacctgagctcctggac -continued cgcggcggacaccgcggctcagatcacccagcgcaagtgggaggcggcccgtgaggcggagcagcTgagagcctacctgg agggcacgtgcgtggagtggctccgcagaCacctggagaacgggaaggagacgctgcagcgcgcgg B*1818 (SEQ ID NO: 1314)
gctcccactccatgaggtatttccacacctccgtgtcccggcccggccgcggggagccccgcttcatctcagtgggctac gtggacggcacccagttcgtgaggttcgacagcgacgccgcgagtccgaggacggagccccgggcgccgtggatagagca agaggggccggagtattgggaccggaacacacagatctccaagaccaacacacagacttaccgagagagcctgcggaacc tgcgcggctactacaaccagagcgaggcccgggtctcacaccctccagaggatgtCtggctgcgacgtggggccggacggg cgcctcctccgcgggcatgaccagtccgcctacgacggcaaggattacatcgccctgaacgaggacctgagctcctggac cgcggcggacaccgcggctcagatcacccagcgcaagtgggaggcggcccgtgtggcggagcagcTgagagcctacctgg agggcacgtgcgtggagtggctccgcagaCacctggagaacgggaaggagacgctgcagcgcgcgg B*2701 (SEQ ID NO: 1315)
gctcccactccatgaggtatttccacacctccgtgtcccggcccggccgcggggagccccgcttcatcaccgtgggctac gtggacgacacgctgttcgtgaggttcgacagcgacgccgcgagtccgagagaggagccgcgggcgccgtggatagagca ggaggggccggagtattgggaccgggagacacagatctGcaaggccaaggcacagacttaccgagagaacctgcgcaCcg CgctcCgctactacaaccagagcgaggcccgggtctcacaccctccagaaTatgtatggctgcgacgtggggccggacggg cgcctcctccgcgggtaccaccagGacgcctacgacggcaaggattacatcgccctgaacgaggacctgagctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggagacgctgcagcgcgcGg B*2702 (SEQ ID NO: 1316)
atgcgggtcacggcgccccgaaccctcctcctgctgctctgggggggcagtggccctgaccgagacctggctggctccca ctccatgaggtatttccacacctccgtgtcccggcccggccgcggggagccccgcttcatcaccgtgggctacgtggacg acacgctgttcgtgaggttcgacagcgacgccgcgagtccgagagaggagccgcgggcgccgtggatagagcaggagggg ccggagtattgggaccgggagacacagatctgcaaggccaaggcacagactgaccgagagaacctgcggatcGCgctcCg ctactacaaccagagcgaggcccgggtctcacaccctccagaaTatgtatggctgcgacgtggggccggacgggcgcctcc tccgcgggtaccaccagGacgcctacgacggcaaggattacatcgccctgaacgaggacctgagctcctggaccgccgcg gacacggcggctcagatcacccagcgcaagtgggaggcggcccgtgTggcggagcagctgagagcctacctggagggcga gtgcgtggagtggctccgcagatacctggagaacgggaaggagacgctgcagcgcgcggacccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgagggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga B*2703 (SEQ ID NO: 1317)
atgcgggtcacggcgccccgaaccctcctcctgctgctctgggggggcagtggccctgaccgagacctggctggctccca ctccatgaggtatttccacacctccgtgtcccggcccggccgcggggagccccgcttcatcaccgtgggctacgtggacg acacgctgttcgtgaggttcgacagcgacgccgcgagtccgagagaggagccgcgggcgccgtggatagagcaggagggg ccggagCattgggaccgggagacacagatctgcaaggccaaggcacagactgaccgagaggacctgcggaccctgctccg ctactacaaccagagcgaggcccgggtctcacaccctccagaatatgtatggctgcgacgtggggccggacgggcgcctcc tccgcgggtaccaccaggacgcctacgacggcaaggattacatcgccctgaacgaggacctgagctcctggaccgccgcg gacacggcggctcagatcacccagcgcaagtgggaggcggcccgtgtggcggagcagctgagagcctacctggagggcga gtgcgtggagtggctccgcagatacctggagaacgggaaggagacgctgcagcgcgcggacccccaaagacacacgtga

```
cccaccacccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagctcaggtgga
```

B*2704

(SEQ ID NO: 1318)
```
atgcgggtcacggcgccccgaaccctcctcctgctgctctgggggcagtggccctgaccgagacctgggctggctccca ctccatgaggtatttccacacctccgtgtcccggcccggccgcggggagccccgcttcatcaccgtgggctacgtggacg acacgctgttcgtgaggttcgacagcgacgccgcgagtccgagagaggagccgcgggcgccgtggatagagcaggagggg ccggagtattgggaccgggagacacagatctgcaaggccaaggcacagactgaccgagagagcctgcggaccctgctccg ctactacaaccagagcgaggccgggtctcacaccctccagaatatgtatggctgcgacgtggggccggacgggcgcctcc tccgcgggtaccaccagGacgcctacgacggcaaggattacatcgccctgaacgaggacctgagctcctggaccgccgcg gacacggcggctcagatcacccagcgcaagtgggaggcggcccgtgaggcggagcagctgagagcctacctggagggcga gtgcgtggagtggctccgcagatacctggagaacgggaaggagacgctgcagcgcgcggacccccccaaagacacacgtga cccaccacccatctctgaccatgaggccaccctgaggtgctgggccctgggcttctaccctgGggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagctcaggtgga
```

B*270502

(SEQ ID NO: 1319)
```
atgcgggtcacggcgccccgaaccctcctcctgctgctctgggggcagtggccctgaccgagacctgggctggctccca ctccatgaggtatttccacacctccgtgtcccggcccggccgcggggagccccgcttcatcaccgtgggctacgtggacg acacgctgttcgtgaggttcgacagcgacgccgcgagtccgagagaggagccgcgggcgccgtggatagagcaggagggg ccggagtattgggaccgggagacacagatctGcaaggccaaggcacagactgaccgagagGacctgcggaccctgctccg ctactacaaccagagcgaggccgggtctcacaccctccagaaTatgtatggctgcgacgtggggccggacgggcgcctcc tccgcgggtaccaccagGacgcctacgacggcaaggattacatcgccctgaacgaggacctgAgctcctggaccgccgcg gacacggcggctcagatcacccagcgcaagtgggaggcggcccgtgtggcggagcagcTgagagcctacctggagggcga gtgcgtggagtggctccgcagatacctggagaacgggaaggagacgctgcagcgcgcggacccccccaaagacacacgtga cccaccacccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga
```

B*270503

(SEQ ID NO: 1320)
```
gctacgtggacgacacgctgttcgtgaggttcgacagcgacgccgcgagtccgagagaggagccgcgggcgccgtggata gagcaggaggggccggagtattgggaccgggagacacagatctgcaaggccaaggcacagactgaccgagaggacctgcg gaccctgctccgctactacaaccagagcgaggccgggtctcacaccctccagaatatgtatggctgcgacgtggggccgg acgggcgcctcctccgcgggtaccaccaggacgcctacgacggcaaggattacatcgccctgaacgaggacctgagctcc tggaccgccgcggacacggcAgctcagatcacccagcgcaagtgggaggcggcccgtgtggcggagcagctgagagccta cctggagggcgagtgcgtggagtggct
```

-continued

B*270504
(SEQ ID NO: 1321)
atgcgggtcacggcgccccgaaccctcctcctgctgctctgggggcaGtggccctgaccgagacctgggccggctccca ctccatgaggtatttccacacctccgtgtcccggcccggccgcggggagccccgcttcatcaccgtgggctacgtggacg acacgctgttcgtgaggttcgacagcgacgccgcgagtccgagagaggagccgcgggcgccgtggatagagcaggaggg ccggagtattgggaccggggagacacagatctGcaaggccaaggcacagactgaccgagagGacctgcggaccctgctccg ctactacaaccagagcgaggccgggtctcacaccctccagaaTatgtaTggctgcgacgtggggccggacgggcgcctcc tccgcgggtaccaccagGacgcctacgacggcaaggattacatcgccctgaacgaggacctgAgctcctggaccgccgcg gacacggcggctcagatcacccagcgcaagtgggaggcggcccgtgTggcggagcagcTgagagcctacctggagggcga gtgcgtggagtggctccgcagatacctggagaacgggaaggagacgctgcagcgcgcGg B*270505
(SEQ ID NO: 1322)
atgcgggtcacggcgccccgaaccctcctcctgctgctctgggggcagtggccctgaccgagacctgggctggctccca ctccatgaggtatttccacacctccgtgtcccggcccggccgcggggagccccgcttcatcaccgtgggctacgtggacg acacgctgttcgtgaggttcgacagcgacgccgcgagtccgagagaggagccgcgggcgccgtggatagagcaggaggg ccggagtattgggaccggggagacacagatctgcaaggccaaggcacagactgaccgagaggacctgcggaccctgctccg ctactacaaccagagcgaggccggTtctcacaccctccagaatatgtatggctgcgacgtggggccggacgggcgcctcc tccgcgggtaccaccaggacgcctacgacggcaaggattacatcgccctgaacgaggacctgagctcctggaccgccgcg gacacggcggctcagatcacccagcgcaagtgggaggcggcccgtgtggcggagcagctgagagcctacctggagggcga gtgcgtggagtggctccgcagatacctggagaacgggaaggagacgctgcagcgcgcggaccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatggg B*270506
(SEQ ID NO: 1323)
gctcccactccatgaggtatttccacacctccgtgtcccggccTggccgcggggagccccgcttcatcaccgtgggctac gtggacgacacgctgttcgtgaggttcgacagcgacgccgcgagtccgagagaggagccgcgggcgccgtggatagagca ggagggccggagtattgggaccggggagacacagatctgcaaggccaaggcacagactgaccgagaggacctgcggaccc tgctccgctactacaaccagagcgaggccgggtctcacaccctccagaatatgtatggctgcgacgtggggccggacggg cgcctcctccgcgggtaccaccaggacgcctacgacggcaaggattacatcgccctgaacgaggacctgAgctcctggac cgccgcggacacggcggctcagatcacccagcgcaagtgggaggcggcccgtgtggcggagcagctgagagcctacctgg agggcgagtgcgtggagtggctccgcagatacctggagaacgggaaggagacgctgcagcgcgcgg B*2706
(SEQ ID NO: 1324)
atgcgggtcacggcgccccgaaccctcctcctgctgctctgggggcagtggccctgaccgagacctgggctggctccca ctccatgaggtatttccacacctccgtgtcccggcccggccgcggggagccccgcttcatcaccgtgggctacgtggacg acacgctgttcgtgaggttcgacagcgacgccgcgagtccgagagaggagccgcgggcgccgtggatagagcaggaggg ccggagtattgggaccggggagacacagatctgcaaggccaaggcacagactgaccgagagagcctgcggaccctgctccg ctactacaaccagagcgaggccgggtctcacaccctccagaatatgtatggctgcgacgtggggccggacgggcgcctcc tccgcgggtatgaccagtacgcctacgacggcaaggattacatcgccctgaacgaggacctgagctcctggaccgccgcg gacacggcggctcagatcacccagcgcaagtgggaggcggcccgtgaggcggagcagctgagagcctacctggagggcga gtgcgtggagtggctccgcagatacctggagaacgggaaggagacgctgcagcgcgcggaccccccaaagacacacgtga cccaccaccccatctctgaccatgaggccaccctgaggtgctgggccctgggcttctaccctgGggagatcacactgacc tggcagcgggatggcgaggaccaaactcaggacactgagcttgtggagaccagaccagcaggagatagaaccttccagaa -continued gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagctcaggtgga

B*2707

(SEQ ID NO: 1325)

ggctcccactccatgaggtatttccacacctccgtgtcccggcccggccgcggggagcccgcttcatcaccgtgggcta cgtggacgacacgctgttcgtgaggttcgacagcgacgccgcgagtccgagagaggagccgcgggcgccgtggatagagc aggaggggccggagtattgggaccgggagacacagatctgcaaggccaaggcacagactgaccgagagGacctgcggacc ctgctcCgctactacaaccagagcgaggccgggtctcacaccctccagagcatgtacggctgcgacgtggggccggacgg gcgcctcctccgcgggcatAaccagtacgcctacgacggcaaggattacatcgccctgaacgaggacctgcgctcctgga ccgccgcggacacggcggctcagatcacccagcgcaagtgggaggcggcccgtgtggcggagcagcTgagagcctacctg gagggcgagtgcgtggagtggctccgcagataccggagaacgggaaggagacgctgcagcgcgcggaccccccaaagac acacgtgacccaccaccccatctctgaccatgaggccaccctgaggtgctgggccctgggcttctaccctgcggagatca cactgacctggcagcgggatggcgaggaccaaactcaggacactgagcttgtggagaccagaccagcaggagatagaacc ttccagaagtgggcagctgtggtggtgccttctggagaagagcagagatacacatgccatgtacagcatgaggggctgcc gaagcccctcaccctgagatgggagccgtcttcccagtccaccgtccccatcgtgggcattgttgctggcctggctgtcc ta...gcagttgtggtcatcggagctgtggtcgctgctgtgatgtgtaggaggaagagCtcaggtgga

B*2708

(SEQ ID NO: 1326)

atgcgggtcacggcgcccgaaccctcctcctgctgctctgggggcagtggccctgaccgagacctgggctggctccca ctccatgaggtatttccacacctccgtgtcccggcccggccgcggggagcccgcttcatcaccgtgggctacgtggacg acacgctgttcgtgaggttcgacagcgacgccgcgagtccgagagaggagccgcgggcgccgtggatagagcaggagggg ccggagtattgggaccgggagacacagatctGcaaggccaaggcacagactgaccgagagagcctgcggaacctgcgcgg ctactacaaccagagcgaggccgggtctcacaccctccagaaTatgtatggctgcgacgtggggccggacgggcgcctcc tccgcgggtaccaccagGacgcctacgacggcaaggattacatcgccctgaacgaggacctgagctcctggaccgccgcg gacacggcggctcagatcacccagcgcaagtgggaggcggcccgtgTggcggagcagctgagagcctacctggagggcga gtgcgtggagtggctccgcagataccggagaacgggaaggagacgctgcagcgcgcggaccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*2709

(SEQ ID NO: 1327)

atgcgggtcacggcgcccgaaccctcctcctgctgctctgggggcagtggccctgaccgagacctgggctggctccca ctccatgaggtatttccacacctccgtgtcccggcccggccgcggggagcccgcttcatcaccgtgggctacgtggacg acacgctgttcgtgaggttcgacagcgacgccgcgagtccgagagaggagccgcgggcgccgtggatagagcaggagggg ccggagtattgggaccgggagacacagatctgcaaggccaaggcacagactgaccgagaggacctgcggaccctgctccg ctactacaaccagagcgaggccgggtctcacaccctccagaatatgtatggctgcgacgtggggccggacgggcgcctcc tccgcgggtaccaccagCacgcctacgacggcaaggattacatcgccctgaacgaggacctgagctcctggaccgccgcg gacacggcggctcagatcacccagcgcaagtgggaggcggcccgtgtggcggagcagctgagagcctacctggagggcga gtgcgtggagtggctccgcagataccggagaacgggaaggagacgctgcagcgcgcggaccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagctcaggtgga

B*2710

(SEQ ID NO: 1328)

gctcccactccatgaggtatttccacacctccgtgtcccggcccggccgcggggagccccgcttcatcaccgtgggctac gtggacgacacgctgttcgtgaggttcgacagcgacgccgcgagtccgagagaggagccgcgggcgccgtggatagagca ggaggggccggagtattgggaccgggagacacagatctGcaaggccaaggcacagactgaccgagagGacctgcggaccc tgctccgctactacaaccagagcgaggccgggtctcacaccctccagaaTatgtaTggctgcgacgtggggccggacggg cgcctcctccgcgggtaccaccagGacgcctacgacggcaaggattacatcgccctgaacgaggacctgAgctcctggac cgccgcggacacggcggctcagatcacccagcgcaagtgggaggcggcccgtgaggcggagcagcTgagagcctacctgg agggcgagtgcgtggagtggctccgcagatacctggagaacgggaaggagacgctgcagcgcgcGg

B*2711

(SEQ ID NO: 1329)

atgcgggtcacggcgccccgaaccctcctcctgctgctctggggggcagtggccctgaccgagacctgggcTggctccca ctccatgaggtatttccacacctccgtgtcccggcccggccgcggggagccccgcttcatcaccgtgggctacgtggacg acacgctgttcgtgaggttcgacagcgacgccgcgagtccgagagaggagccgcgggcgccgtggatagagcaggagggg ccggagtattgggaccgggagacacagatctgcaaggccaaggcacagactgaccgagagagcctgcggaccctgctcCg ctactacaaccagagcgaggccgggtctcacaccctccagagcatgtacggctgcgacgtggggccggacgggcgcctcc tccgcgggcatAaccagtacgcctacgacggcaaggattacatcgccctgaacgaggacctgcgctcctggaccgccgcg gacacggcggctcagatcacccagcgcaagtgggaggcggcccgtgTggcggagcagcTgagagcctacctggagggcga gtgcgtggagtggctccgcagatacctggagaacgggaaggagacgctgcagcgcgcggacccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*2712

(SEQ ID NO: 1330)

atgcgggtcacggcgccccgaaccctcctcctgctgctctggggggcagtggccctgaccgagacctgggctggctccca ctccatgaggtatttccacacctccgtgtcccggcccggccgcggggagccccgcttcatcaccgtgggctacgtggacg acacgctgttcgtgaggttcgacagcgacgccgcgagtccgagagaggagccgcgggcgccgtggatagagcaggagggg ccggagtattgggaccgggagacacagatctGcaagaccaacAcacagactgaccgagagagcctgcggaacctgcgcgg ctactacaaccagagcgaggccgggtctcacaccctccagaaTatgtatggctgcgacgtggggccggacgggcgcctcc tccgcgggtaccaccagGacgcctacgacggcaaggattacatcgccctgaacgaggacctgagctcctggaccgccgcg gacacggcggctcagatcacccagcgcaagtgggaggcggcccgtgTggcggagcagctgagagcctacctggagggcga gtgcgtggagtggctccgcagatacctggagaacgggaaggagacgctgcagcgcgcggacccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*2713

(SEQ ID NO: 1331)

atgcgggtcacggagccccgaaccctcctcctgctgctctgggggcagtggccctgaccgagacctgggctggctccca ctccatgaggtatttccacacctccgtgtcccggcccggccgcggggagccccgcttcatcaccgtgggctacgtggacg acacgctgttcgtgaggttcgacagcgacgccgcgagtccgagagaggagccgcgggcgccgtggatagagcaggaggg ccggagtattgggaccgggagacacagatctGcaaggccaaggcacagactgaccgagagGacctgcggaccctgctccg ctactacaaccagagcgaggccgggtctcacaccctccagaaTatgtatggctgcgacgtggggccggacgggcgcctcc tccgcgggtaccaccagGacgcctacgacggcaaggattacatcgccctgaacgaggacctgAgctcctggaccgccgcg gacacggcggctcagatcacccagcgcaagtgggaggcggcccgtgtggcggagcagcTgagagcctacctggagggcga gtgcgtggagtggctccgcagatacctggagaacgggaaggagacgctgcagcgcgcggaccccccaaagacacacgtga cccaccacccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*2714

(SEQ ID NO: 1332)

atgcgggtcacggcgccccgaaccctcctcctgctgctctgggggcagtggccctgaccgagacctgggctggctccca ctccatgaggtatttccacacctccgtgtcccggcccggccgcggggagccccgcttcatcaccgtgggctacgtggacg acacgctgttcgtgaggttcgacagcgacgccgcgagtccgagagaggagccgcgggcgccgtggatagagcaggagggg ccggagtattgggaccgggagacacagatctgcaaggccaaggcacagactgaccgagagGacctgcggaccctgctccg ctactacaaccagagcgaggccgggtctcacacttggcagacgatgtatggctgcgacCtggggccggacgggcgcctcc tccgcgggtaccaccagGacgcctacgacggcaaggattacatcgccctgaacgaggacctgAgctcctggaccgccgcg gacacggcggctcagatcacccagcgcaagtgggaggcggcccgtgTggcggagcagcTgagagcctacctggagggcga gtgcgtggagtggctccgcagatacctggagaacgggaaggagacgctgcagcgcgcGg

B*2715

(SEQ ID NO: 1333)

gctcccactccatgaggtatttccacacctccgtgtcccggcccggccgcggggagccccgcttcatcaccgtgggctac gtggacgacacgctgttcgtgaggttcgacagcgacgccgcgagtccgagagaggagccgcgggcgccgtggatagagca ggaggggccggagtattgggaccgggagacacagatctgcaaggccaaggcacagactgaccgagagagcctgcggaccc tgctccgctactacaaccagagcgaggccgggtctcacaccctccagaaTatgtatggctgcgacgtggggccggacggg cgcctcctccgcgggtaccaccagGacgcctacgacggcaaggattacatcgccctgaacgaggacctgagctcctggac cgccgcggacacggcggctcagatcacccagcgcaagtgggaggcggcccgtgaggcggagcagctgagagcctacctgg agggcaCgtgcgtggagtggctccgcagatacctggagaacgggaaggagacgctgcagcgcgcGg

B*2716

(SEQ ID NO: 1334)

gctcccactccatgaggtatttccacacctccgtgtcccggcccggccgcggggagccccgcttcatcaccgtgggctac gtggacgacacgctgttcgtgaggttcgacagcgacgccgcgagtccgagagaggagccgcgggcgccgtggatagagca ggaggggccggagtattgggaccgggagacacagatctGcaagaccaacAcacagactgaccgagagGacctgcggaccc tgctccgctactacaaccagagcgaggccgggtctcacaccctccagaaTatgtaTggctgcgacgtggggccggacggg cgcctcctccgcgggtaccaccagGacgcctacgacggcaaggattacatcgccctgaacgaggacctgAgctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggagacgctgcagcgcgcGg

B*2717

(SEQ ID NO: 1335)

gctcccactccatgaggtatttccacacctccgtgtcccggcccggccgcggggagccccgcttcatcaccgtgggctac gtggacgacacgctgttcgtgaggttcgacagcgacgccgcgagtccgagagaggagccgcgggcgccgtggatagagca ggaggggccggagtTttgggaccgggagacacagatctgcaaggccaaggcacagactgaccgagaggacctgcggaccc tgctccgctactacaaccagagcgaggccgggtctcacaccctccagaatatgtatggctgcgacgtggggccggacggg cgcctcctccgcgggtaccaccaggacgcctacgacggcaaggattacatcgccctgaacgaggacctgagctcctggac cgccgcggacacggcggctcagatcacccagcgcaagtgggaggcggcccgtgtggcggagcagctgagagcctacctgg agggcgagtgcgtggagtggctccgcagatacctggagaacgggaaggagacgctgcagcgcgcgg

B*2718

(SEQ ID NO: 1336)

atgcgggtcacggcgccccgaaccctcctcctgctgctctgggggggcagtggccctgaccgagacctgggctggctccca ctccatgaggtatttcCacacctccgtgtcccggcccggccgcggggagccccgcttcatcaccgtgggctacgtggacg acacgcTgttcgtgaggttcgacagcgacgccgcgagtccgagagaggagccgcgggcgccgtggatagagcaggagggg ccggagtattgggaccgggagacacagatctCcaagaccaacAcacagactTaccgagagagcctgcggaacctgcgcgg ctactacaaccagagcgaggccgggtctcacaccctccagaaTatgtatggctgcgacgtggggccggacgggcgcctcc tccgcgggtaccaccagDacgcctacgacggcaaggattacatcgccctgaacgaggacctgAgctcctggaccgccgcg gacacggcggctcagatcacccagcgcaagtgggaggcggcccgtgaggcggagcagcTgagagcctacctggagggcga gtgcgtggagtggctccgcagatacctggagaacgggaaggagacgctgcagcgcgcgGg

B*2719

(SEQ ID NO: 1337)

gctcccactccatgaggtatttccacacctccgtgtcccggcccggccgcggggagccccgcttcatcaccgtgggctac gtggacgacacgctgttcgtgaggttcgacagcgacgccgcgagtccgagagaggagccgcgggcgccgtggatagagca ggaggggccggagtattgggaccgggagacacagatctgcaaggccaaggcacagactgaccgagagGacctgcggaccc tgctccgctactacaaccagagcgaggccgggtctcacatcAtccagagGatgtacggctgcgacgtggggccggacggg cgcctcctccgcgggtaccaccagDacgcctacgacggcaaggattacatcgccctgaacgaggacctgAgctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggagacgctgcagcgcgcGg

B*2720

(SEQ ID NO: 1338)

gctcccactccatgaggtatttccacacctccgtgtcccggcccggccgcggggagccccgcttcatcaccgtgggctac gtggacgacacgctgttcgtgaggttcgacagcgacgccgcgagtccgagagaggagccgcgggcgccgtggatagagca ggaggggccggagtattgggaccgggagacacagatctgcaaggccaaggcacagactgaccgagagagcctgcggaccc tgctccgctactacaaccagagcgaggccgggtctcacaccctccagaaTatgtacggctgcgacgtggggccggacggg cgcctcctccgcgggcatAaccagtacgcctacgacggcaaggattacatcgccctgaacgaggacctgcgctcctggac cgccgcggacacggcggctcagatcacccagcgcaagtgggaggcggcccgtgaggcggagcagcTgagagcctacctgg agggcgagtgcgtggagtggctccgcagatacctggagaacgggaaggagacgctgcagcgcgcGg

B*2721

(SEQ ID NO: 1339)

gctcccactccatgaggtatttccacacctccgtgtcccggcccggccgcggggagccccgcttcatcaccgtgggctac gtggacgacacgctgttcgtgaggttcgacagcgacgccgcgagtccgagagaggagccgcgggcgccgtggatagagca ggaggggccggagtattgggaccgggagacacagatctGcaaggccaaggcacagactgaccgagagagcctgcggaccc tgctcCgctactacaaccagagcgaggccgggtctcacaccctccagagGatgtacggctgcgacgtggggccggacggg cgcctcctccgcgggTatgaccagtacgcctacgacggcaaggattacatcgccctgaacgaggacctgAgctcctggac cgccgcggacacggcggctcagatcacccagcgcaagtgggaggcggcccgtgaggcggagcagcTgagagcctacctgg agggcgagtgcgtggagtggctccgcagatacctggagaacgggaaggagacgctgcagcgcgcGg

B*2723

(SEQ ID NO: 1340)

gctcccactccatgaggtatttccacacctccgtgtcccggcccggccgcggggagccccgcttcatcaccgtgggctac gtggacgacacgctgttcgtgaggttcgacagcgacgccgcgagtccgagagaggagccgcgggcgccgtggatagagca ggaggggccggagtattgggaccggaacacacagatctTcaagaccaacAcacagactTaccgagagagcctgcggaCcc tgctcCgctactacaaccagagcgaggccgggtctcacaccctccagaaTatgtatggctgcgacgtggggccggacggg cgcctcctccgcgggtaccaccagDacgcctacgacggcaaggattacatcgccctgaacgaggacctgagctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggagacgctgcagcgcgcGg

B*2724

(SEQ ID NO: 1341)

gctcccactccatgaggtatttccacacctccgtgtcccggcccggccgcggggagccccgcttcatcaccgtgggctac gtggacgacacgctgttcgtgaggttcgacagcgacgccgcgagtccgagagaggagccgcgggcgccgtggatagagca ggaggggccggagtattgggaccgggagacacagatctgcaaggccaaggcacagactgaccgagagagcctgcggaccc tgctcCgctactacaaccagagcgaggccgggtctcacaccctccagagcatgtacggctgcgacgtggggccggacggg cgcctcctccgcgggcataaccagtacgcctacgacggcaaggattacatcgccctgaacgaggacctgcgctcctggac cgccgcggacacggcggctcagatcTcccagcgcaagtgggaggcggcccgtgaggcggagcagctgagagcctacctgg agggcgagtgcgtggagtggctccgcagatacctggagaacgggaaggagacgctgcagcgcgcGg

B*2725

(SEQ ID NO: 1342)

gctcccactccatgaggtatttccacacctccgtgtcccggcccggccgcggggagccccgcttcatcaccgtgggctac gtggacgacacgctgttcgtgaggttcgacagcgacgccgcgagtccgagagaggagccgcgggcgccgtggatagagca ggaggggccggagtattgggaccgggagacacagatctgcaaggccaaggcacagactgaccgagagagcctgcggaccc tgctccgctactacaaccagagcgaggccgggtctcacaccctccagaaTatgtatggctgcgacgtggggccggacggg cgcctcctccgcgggtaccaccaggacgcctacgacggcaaggattacatcgccctgaacgaggacctgagctcctggac cgccgcggacacggcggctcagatcacccagcgcaagtgggaggcggcccgtgaggcggagcagtggagagcctacctgg agggccTgtgcgtggagtggctccgcagatacctggagaacgggaaggagacgctgcagcgcgcGg

B*350101

(SEQ ID NO: 1343)

atgcgggtcacggcgccccgaaccgtcctcctgctgctctgggggcagtggcccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggacggagccccgggcgccatggatagcaggaggggg ccggagtattgggaccggaacacacagatctTcaagaccaacAcacagacttaccgagagagcctgcggaacctgcgcgg ctactacaaccagagcgaggccgggtctcacatcAtccagaggatgtaTggctgcgacctggggcccgacgggcgcctcc tccgcgggcatgaccagtCcgcctacgacggcaaggattacatcgccctgaacgaggacctgAgctcctggaccgcggcg gacaccgcggctcagatcacccagcgcaagtgggaggcggcccgtgTggcggagcagcTgagagcctacctggagggccT gtgcgtggagtggctccgcagatacctggagaacgggaaggagacgctgcagcgcgcggaccccccaaagacacacgtga cccaccaccccGtctctgaccatgaggccaccctgaggtgctgggccctgggcttctaccctgcggagatcacactgacc tggcagcgggatggcgaggaccaaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtcta...gca gttgtggtcatcggagctgtggtcgctactgtgatgtgtaggaggaagagCtcaggtgga -continued

B*350102

(SEQ ID NO: 1344)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagagcctgcggaacc tgcgcggctactacaaccagagcgaggccgggtctcacatcatccagaggatgtatggctgcgacctggggcccgacggg cgcctcctccgcgggcatgaccagtccgcctacgacggcaaggattacatcgccctgaacgaggacctgagctcctggac cgcggcggacaccgcggctcagatcacccagcgcaagtgggaggcggcccgtgtggcggagcagctgagagcTtacctgg agggcctgtgcgtggagtggctccgcagatacctggagaacgggaaggagacgctgcagcgcgcgcgg

B*3502

(SEQ ID NO: 1345)

atgcgggtcacggcgccccgaaccgtcctcctgctgctctgggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggacggagccccgggcgccatggatagagcaggagggg ccggagtattgggaccggaacacacagatcttcaagaccaacacacagacttaccgagagagcctgcggaacctgcgcgg ctactacaaccagagcgaggccgggtctcacatcatccagaggatgtatggctgcgacctggggcccgacgggcgcTtcc tccgcgggcataaccagtacgcctacgacggcaaggattacatcgccctgaacgaggacctgagctcctggaccgcggcg gacaccgcggctcagatcacccagcgcaagtgggaggcggcccgtgtggcggagcagctgagagcctacctggagggcct gtgcgtggagtggctccgcagatacctggagaacgggaaggagacgctgcagcgcgcggacccccccaaagacacacgtga cccaccaccccgtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagctcaggtgga

B*3503

(SEQ ID NO: 1346)

atgcgggtcacggcgccccgaaccgtcctcctgctgctctgggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggacggagccccgggcgccatggatagagcaggagggg ccggagtattgggaccggaacacacagatcttcaagaccaacacacagacttaccgagagagcctgcggaacctgcgcgg ctactacaaccagagcgaggccgggtctcacatcatccagaggatgtatggctgcgacctggggcccgacgggcgcctcc tccgcgggcatgaccagtTcgcctacgacggcaaggattacatcgccctgaacgaggacctgAgctcctggaccgcggcg gacaccgcggctcagatcacccagcgcaagtgggaggcggcccgtgTggcggagcagcTgagagcctacctggagggccT gtgcgtggagtggctccgcagatacctggagaacgggaaggagacgctgcagcgcgcggacccccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*3504

(SEQ ID NO: 1347)

atgcgggtcacggcgccccgaaccgtcctcctgctgctctgggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggacggagccccgggcgccatggatagagcaggagggg ccggagtattgggaccggaacacacagatcttcaagaccaacacacagacttaccgagagagcctgcggaacctgcgcgg -continued ctactacaaccagagcgaggccgggtctcacatcatccagaggatgtatggctgcgacctggggccCgacgggcgcctcc
tccgcgggcatAaccagtacgcctacgacggcaaggattacatcgccctgaacgaggacctgAgctcctggaccgcggcg
gacaccgcggctcagatcacccagcgcaagtgggaggcggcccgtgTggcggagcagcTgagagcctacctggagggccT
gtgcgtggagtggctccgcagatacctggagaacgggaaggagacgctgcagcgcgcggaccccccaaagacacacgtga
cccaccaccccGtctctgaccatgaggccaccctgaggtgctgggccctgggcttctaccctgcggagatcacactgacc
tggcagcgggatggcgaggaccaaactcaggacactgagcttgtggagaccagaccagcaggagatagaaccttccagaa
gtgggcagctgtggtggtgccttctggagaagagcagagatacacatgccatgtacagcatgaggggctgccgaagcccc
tcaccctgagatgggagccatcttcccagtccaccatccccatcgtgggcattgttgctggcctggctgtccta...gca
gttgtggtcatcggagctgtggtcgctactgtgatgtgtaggaggaagagCtcaggtgga

B*3505

(SEQ ID NO: 1348)
atgcgggtcacggcgccccgaaccgtcctcctgctgctctgggggcagtggccctgaccgagacctgggccggctccca
ctccatgaggtatttctacaccgccatgtcccggcccggccgcggggagccccgcttcatcgcagtgggctacgtggacg
acacccagttcgtgaggttcgacagcgacgccgcgagtccgaggacggagccccgggcgccatggatagagcaggagggg
ccggagtattgggaccggaacacacagatctTcaagaccaacAcacagacttaccgagagagcctgcggaacctgcgcgg
ctactacaaccagagcgaggccgggtctcacaccctccagagcatgtacggctgcgacctggggcccgacgggcgcctcc
tccgcgggcatgaccagtCcgcctacgacggcaaggattacatcgccctgaacgaggacctgAgctcctggaccgcggcg
gacaccgcggctcagatcacccagcgcaagtgggaggcggcccgtgTggcggagcagcTgagagcctacctggagggccT
gtgcgtggagtggctccgcagatacctggagaacgggaaggagacgctgcagcgcgcggaccccccaaagacacacgtga
cccaccaccccGtctctgaccatgaggccaccctgaggtgctgggccctgggcttctaccctgcggagatcacactgacc
tggcagcgggatggcgaggaccaaactcaggacactgagcttgtggagaccagaccagcaggagatagaaccttccagaa
gtgggcagctgtggtggtgccttctggagaagagcagagatacacatgccatgtacagcatgaggggctgccgaagcccc
tcaccctgagatgggagccatcttcccagtccaccatccccatcgtgggcattgttgctggcctggctgtccta...gca
gttgtggtcatcggagctgtggtcgctactgtgatgtgtaggaggaagagCtcaggtgga

B*3506

(SEQ ID NO: 1349)
atgcgggtcacggcgccccgaaccgtcctcctgctgctctgggggcagtggccctgaccgagacctgggccggctccca
ctccatgaggtatttctacaccgccatgtcccggcccggccgcggggagccccgcttcatcgcagtgggctacgtggacg
acacccagttcgtgaggttcgacagcgacgccgcgagtccgaggacggagccccgggcgccatggatagagcaggagggg
ccggagtattgggaccggaacacacagatcttcaagaccaacacacagacttaccgagagagcctgcggaacctgcgcgg
ctactacaaccagagcgaggccgggtctcacatcatccagaggatgtatggctgcgacctggggcccgacgggcgcctcc
tccgcgggcatAaccagtTcgcctacgacggcaaggattacatcgccctgaacgaggacctgAgctcctggaccgcggcg
gacaccgcggctcagatcacccagcgcaagtgggaggcggcccgtgTggcggagcagcTgagagcctacctggagggccT
gtgcgtggagtggctccgcagatacctggagaacgggaaggagacgctgcagcgcgcggaccccccaaagacacacgtga
cccaccaccccGtctctgaccatgaggccaccctgaggtgctgggccctgggcttctaccctgcggagatcacactgacc
tggcagcgggatggcgaggaccaaactcaggacactgagcttgtggagaccagaccagcaggagatagaaccttccagaa
gtgggcagctgtggtggtgccttctggagaagagcagagatacacatgccatgtacagcatgaggggctgccgaagcccc
tcaccctgagatgggagccatcttcccagtccaccatccccatcgtgggcattgttgctggcctggctgtccta...gca
gttgtggtcatcggagctgtggtcgctactgtgatgtgtaggaggaagagCtcaggtgga

B*3507

(SEQ ID NO: 1350)
atgcgggtcacggcgccccgaaccgtcctcctgctgctctgggggcagtggccctgaccgagacctgggccggctccca
ctccatgaggtatttctacaccgccatgtcccggcccgTccgcggggagccccgcttcatcgcagtgggctacgtggacg -continued acacccagttcgtgaggttcgacagcgacgccgcgagtccgaggacggagccccgggcgccatggatagagcaggagggg ccggagtattgggaccggaacacacagatcttcaagaccaacacacagacttaccgagagagcctgcggaacctgcgcgg ctactacaaccagagcgaggccgggtctcacatcatccagaggatgtatggctgcgacctggggcccgacgggcgcctcc tccgcgggcatgaccagtccgcctacgacggcaaggattacatcgccctgaacgaggacctgagctcctggaccgcggcg gacaccgcggctcagatcacccagcgcaagtgggaggcggcccgtgtggcggagcagctgagagcctacctggagggcct gtgcgtggagtggctccgcagatacctggagaacgggaaggagacgctgcagcgcgcggaccccccaaagacacacgtga cccaccaccccgtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagctcaggtgga

B*3508

(SEQ ID NO: 1351)

atgcgggtcacggcgccccgaaccgtcctcctgctgctctgggggcagtggccctgaccgagacctgggccggctccca ctccatgaggtatttctacaccgccatgtcccggcccggccgcggggagcccgcttcatcgcagtgggctacgtggacg acacccagttcgtgaggttcgacagcgacgccgcgagtccgaggacggagccccgggcgccatggatagagcaggagggg ccggagtattgggaccggaacacacagatctTcaagaccaacAcacagacttaccgagagagcctgcggaacctgcgcgg ctactacaaccagagcgaggccgggtctcacatcAtccagaggatgtaTggctgcgacctggggcccgacgggcgcctcc tccgcgggcatgaccagtCcgcctacgacggcaaggattacatcgccctgaacgaggacctgAgctcctggaccgcggcg gacaccgcggctcagatcacccagcgcaagtgggaggcggcccgtgTggcggagcagcggagagcctacctggagggccT gtgcgtggagtggctccgcagatacctggagaacgggaaggagacgctgcagcgcgcggaccccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*350901

(SEQ ID NO: 1352)

atgcgggtcacggcgccccgaaccgtcctcctgctgctctgggggcagtggccctgaccgagacctgggccggctccca ctccatgaggtatttctacaccgccatgtcccggcccggccgcggggagcccgcttcatcgcagtgggctacgtggacg acacccagttcgtgaggttcgacagcgacgccgcgagtccgaggacggagccccgggcgccatggatagagcaggagggg ccggagtattgggaccggaacacacagatcttcaagaccaacacacagacttaccgagagagcctgcggaacctgcgcgg ctactacaaccagagcgaggccgggtctcacatcatccagaggatgtatggctgcgacctggggccCgacgggcgcctcc tccgcgggcatAaccagtacgcctacgacggcaaggattacatcgccctgaacgaggacctgcgctcctggaccgcggcg gacaccgcggctcagatcacccagcgcaagtgggaggcggcccgtgTggcggagcagcTgagagcctacctggagggccT gtgcgtggagtggctccgcagatacctggagaacgggaaggagacgctgcagcgcgcggaccccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga -continued

B*350902

(SEQ ID NO: 1353)
gctcccactccatgaggtatttctacaccgccatgtcccggcccggccgcggggagccccgcttcatcgcagtgggctac
gtggacgacacccagttcgtgaggttcgacagcgacgccgcgagtccgaggacggagccccgggcgccatggatagagca
ggaggggccggagtattgggaccggaacacacagatctTcaagaccaacacacagacttaccgagagagcctgcggaacc
tgcgcggctactacaaccagagcgaggccgggtctcacatcatccagaggatgtatggctgcgacctggggccCgacggg
cgcctcctccgcgggcatAaccagtacgcctacgacggcaaggattacatcgccctgaacgaggacctgcgctcctggac
cgccgcggacacggcggctcagatcacccagcgcaagtgggaggcggcccgtgTggcggagcagcTgagagcctacctgg
agggccTgtgcgtggagtggctccgcagatacctggagaacgggaaggagacgctgCagcgcgcGg

B*3510

(SEQ ID NO: 1354)
gctcccactccatgaggtatttctacaccgccatgtcccggcccggccgcggggagccccgcttcatcgcagtgggctac
gtggacgacacccagttcgtgaggttcgacagcgacgccgcgagtccgaggacggagccccgggcgccatggatagagca
ggaggggccggagtattgggacccgggaGacacagatctTcaagaccaacAcacagactTaccgagagagcctgcggaacc
tgcgcggctactacaaccagagcgaggccgggtctcacatcAtccagaggatgtaTggctgcgacCtggggccCgacggg
cgcctcctccgcgggcatgaccagtCcgcctacgacggcaaggattacatcgccctgaacgaggacctgAgctcctggac
cgcggcggacacCgcggctcagatcacccagcgcaagtgggaggcggcccgtgTggcggagcagcTgagagcctacctgg
agggccTgtgcgtggagtggctccgcagatacctggagaacggga

B*3511

(SEQ ID NO: 1355)
atgcgggtcacggcgccccgaaccgtcctcctgctgctctgggggcagtggccctgaccgagacctgggccggctccca
ctccatgaggtatttctacaccgccatgtcccggcccggccgcggggagcccgcttcatcgcagtgggctacgtggacg
acacccagttcgtgaggttcgacagcgacgccgcgagtccgaggacggagccccgggcgccatggatagagcaggagggg
ccggagtattgggaccggaacacacagatctTcaagaccaacAcacagacttaccgagagagcctgcggaacctgcgcgg
ctactacaaccagagcgaggccgggtctcacatcAtccagaggatgtaTggctgcgacctggggcccgacgggcgcctcc
tccgcgggcatgaccagtCcgcctacgacggcaaggattacatcgccctgaacgaggacctgAgctcctggaccgcggcg
gacaccgcggctcagatcacccagcgcaagtgggaggcggcccgtgaggcggagcagcTgagagcctacctggagggccT
gtgcgtggagtggctccgcagatacctggagaacgggaaggagacgctgcagcgcgcggacccccccaaagacacacgtga
cccaccaccccGtctctgaccatgaggccacccctgaggtgctgggccctgggcttctaccctgcggagatcacactgacc
tggcagcgggatggcgaggaccaaactcaggacactgagcttgtggagaccagaccagcaggagatagaaccttccagaa
gtgggcagctgtggtggtgccttctggagaagagcagagatacacatgccatgtacagcatgagggctgccgaagcccc
tcaccctgagatgggagccatcttcccagtccaccatccccatcgtgggcattgttgctggcctggctgtccta...gca
gttgtggtcatcggagctgtggtcgctactgtgatgtgtaggaggaagagCtcaggtgga

B*3512

(SEQ ID NO: 1356)
atgcgggtcacggcgccccgaaccgtcctcctgctgctctgggggcagtggccctgaccgagacctgggccggctccca
ctccatgaggtatttctacaccgccatgtcccggcccggccgcggggagcccgcttcatcgcagtgggctacgtggacg
acacccagttcgtgaggttcgacagcgacgccgcgagtccgaggacggagccccgggcgccatggatagagcaggagggg
ccggagtattgggaccggaacacacagatcttcaagaccaacacacagacttaccgagagagcctgcggaacctgcgcgg
ctactacaaccagagcgaggccgggtctcacatcatccagaggatgtacggctgcgacgtggggccggacgggcgcctcc
tccgcgggcatAaccagtacgcctacgacggcaaggattacatcgccctgaacgaggacctgAgctcctggaccgcggcg
gacaccgcggctcagatcacccagcgcaagtgggaggcggcccgtgTggcggagcagcTgagagcctacctggagggccT
gtgcgtggagtggctccgcagatacctggagaacgggaaggagacgctgcagcgcgcggacccccccaaagacacacgtga
cccaccaccccGtctctgaccatgaggccacccctgaggtgctgggccctgggcttctaccctgcggagatcacactgacc -continued tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgagggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*3513

(SEQ ID NO: 1357)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggacgggaGacacagatctTcaagaccaacacacagactTaccgagagagcctgcggaacc tgcgcggctactacaaccagagcgaggcccgggtctcacatcatccagaggatgtatggctgcgacctggggccCgacggg cgcctcctccgcgggcatgaccagtTcgcctacgacggcaaggattacatcgccctgaacgaggacctgAgctcctggac cgcggcggacacCgcggctcagatcacccagcgcaagtgggaggcggcccgtTggcggagcagcTgagagcctacctgg agggccTgtgcgtggagtggctccgcagatacctggagaacgggaaggagacgctgCagcgcgcGg

B*3514

(SEQ ID NO: 1358)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggacgggacacacagatcttcaagaccaacacacagacttaccgagagagcctgcggaacc tgcgcggctactacaaccagagcgaggcccgggtctcacatcatccagaggatgtatggctgcgacctggggcccgacggg cgcctcctccgcgggcatgaccagtccgcctacgacggcaaggattacatcgccctgaacgaggacctgagctcctggac cgcggcggacacCgcggctcagatcacccagcgcaagtgggaggcggcccgtgaggcggagcagTggagagcctacctgg agggccTgtgcgtggagtggctccgcagatacctggagaacgggaaggagacgctgcagcgcgcGg

B*3515

(SEQ ID NO: 1359)

atgcgggtcacggcgccccgaaccgtcctcctgctgctctggggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggacggagccccgggcgccatggatagagcaggaggggg ccggagtattgggaccggaacacacagatctTcaagaccaacAcacagacttaccgagagagcctgcggaacctgcgcgg ctactacaaccagagcgaggcccgggtctcacatcAtccagaggatgtaTggctgcgacctggggcccgacggggccctcc tccgcgggcatgaccagtCcgcctacgacggcaaggattacatcgccctgaacgaggacctgAgctcctggaccgcggcg gacaccgcggctcagatcacccagcgcaagtgggaggcggcccgtgTggcggagcagcTgagagcctacctggagggcga gtgcgtggagtggctccgcagatacctggagaacgggaaggagacgctgcagcgcgcggacccccccaaagacacacgtga cccaccaccccGtctctgaccatgaggccacccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgagggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*3516

(SEQ ID NO: 1360)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggacgggaGacacagatctTcaagaccaacAcacagactTaccgagagagcctgcggaacc tgcgcggctactacaaccagagcgaggcccgggtctcacatcAtccagagcatgtacggctgcgacgtggggccCgacggg cgcctcctccgcgggcatgaccagtCcgcctacgacggcaaggattacatcgccctgaacgaggacctgAgctcctggac

B*3517

(SEQ ID NO: 1361)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccCcgggcgccAtggatagagca ggaggggccggagtattgggaccggaacacacagatctTcaagaccaacAcacagactTaccgagagagcctgcggaacc tgcgcggctactacaaccagagcgaggccgggtctcacatcAtccagagcatgtacggctgcgacgtggggccCgacggg cgcctcctccgcgggcatgaccagtCcgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgCagcgcgcGg

B*3518

(SEQ ID NO: 1362)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagcccgggcgccatggatagagca ggaggggccggagtattgggaccggaacacacagatctTcaagaccaacAcacagacttaccgagagagcctgcggaacc tgcgcggctactacaaccagagcgaggccgggtctcacatcAtccagaggatgtatggctgcgacctggggccCgacggg cgcctcctccgcgggcatAaccagtacgcctacgacggcaaggattacatcgccctgaacgaggacctgcgctcctggac cgccgcggacacggcggctcagatcacccagcgcaagtgggaggcggcccgtgTggcggagcagcggagagcctacctgg agggccTgtgcgtggagtggctccgcagatacctggagaacgggaaggagacgctgCagcgcgcGg

B*3519

(SEQ ID NO: 1363)

gctcccactccatgaggtatttctacaccgccatgtcccggcccggccgcggggagccccgcttcatcgcagtgggctac gtggacgacacccagttcgtgaggttcgacagcgacgccgcgagtccgaggaaggagccgcgggcgccAtggatagagca ggaggggccggagtattgggaccggaacacacagatctTcaagaccaacAcacagactTaccgagagagcctgcggaacc tgcgcggctactacaaccagagcgaggccgggtctcacatcAtccagaggatgtaTggctgcgacCtggggccCgacggg cgcctcctccgcgggcatgaccagtCcgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgCagcgcgcGg

B*3520

(SEQ ID NO: 1364)

gctcccactccatgaggtatttctacaccgccatgtcccggcccggccgcggggagccccgcttcatcgcagtgggctac gtggacgacacccagttcgtgaggttcgacagcgacgccgcgagtccgaggaCggagcccccgggcgccAtggatagagca ggaggggccggagtattgggaccggaacacacagatctCcaagaccaacAcacagactTaccgagagagcctgcggaacc tgcgcggctactacaaccagagcgaggccgggtctcacatcAtccagaggatgtaTggctgcgacCtggggccCgacggg cgcctcctccgcgggcatgaccagtCcgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgCagcgcgcGg

B*3521

(SEQ ID NO: 1365)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagcccgggcgccatggatagagca ggaggggccggagtattgggaccggaacacacagatcttcaagaccaacacacagacttaccgagagagcctgcggaacc tgcgcggctactacaaccagagcgaggccgggtctcacatcatccagaggatgtatggctgcgacctggggcccgacggg cgcctcctccgcgggcatgaccagtCcgcctacgacggcaaggattacatcgccctgaacgaggacctgAgctcctggac -continued cgcggcggacacCgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*3522

(SEQ ID NO: 1366)
gctcccactccatgaggtatttctacaccgccatgtcccggcccggccgcggggagccccgcttcatcgcagtgggctac gtggacgacacccagttcgtgaggttcgacagcgacgccgcgagtccgaggaCggagccccgggcgccatggatagagca ggaggggccggagtattgggaccggaacacacagatctTcaagaccaacacacagacttaccgagagagcctgcggaacc tgcgcggctactacaaccagagcgaggcccgggtctcacaccctccagagcatgtacggctgcgacgtggggccggacggg cgcctcctccgcgggcatAaccagtacgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgcagcgcgcGg

B*3523

(SEQ ID NO: 1367)
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagagcctgcggaacc tgcgcggctactacaaccagagcgaggcccgggtctcacatcatccagaggatgtTtggctgcgacctggggcccgacggg cgcctcctccgcgggcatgaccagtCcgcctacgacggcaaggattacatcgccctgaacgaggacctgagctcctggac cgcggcggacaccgcggctcagatcacccagcgcaagtgggaggcggcccgtgTggcggagcagcTgagagcctacctgg agggccTgtgcgtggagtggctccgcagatacctggagaacgggaaggagacgctgcagcgcgcGg

B*3524

(SEQ ID NO: 1368)
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagagcctgcggaacc tgcgcggctactacaaccagagcgaggcccgggtctcacatcatccagaggatgtatggctgcgacctggggcccgacggg cgcctcctccgcgggcatgaccagtCcgcctacgacggcaaggattacatcgccctgaacgaggacctgagctcctggac cgcggcggacaccgcggctcagatcacccagcgcaagtgggaggcggcccgtgTggcggagcagcTgagagcctacctgg agggccTgtgcgtggagtggctccgcagaCacctggagaacgggaaggagacgctgcagcgcgcgg

B*3525

(SEQ ID NO: 1369)
gctcccactccatgaggtatttctacaccgccatgtcccggcccggccgcggggagccccgcttcatctcagtgggctac gtggacgacacGcagttcgtgaggttcgacagcgacgccgcgagtccgagagaggagccgcgggcgccgtggatagagca ggaggggccggagtattgggaccggaacacacagatctTcaagaccaacAcacagactTaccgagagagcctgcggaacc tgcgcggctactacaaccagagcgaggcccgggtctcacatcAtccagaggatgtaTggctgcgacCtggggccCgacggg cgcctcctccgcgggcatgaccagtCcgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgCagcgcgcGg

B*3526

(SEQ ID NO: 1370)
gctcccactccatgaggtatttctacaccgccatgtcccggcccggccgcggggagccccgcttcatcgcagtgggctac gtggacgacacccagttcgtgaggttcgacagcgacgccgcgagtccgagagaggagccccgggcgccatggatagagca ggaggggccggaAtattgggaccggaacacacagatctgcaagaccaacacacagacttaccgagagagcctgcggaacc tgcgcggctactacaaccagagcgaggcccgggtctcacatcatccagaggatgtatggctgcgacctggggcccgacggg cgcctcctccgcgggcatgaccagtccgcctacgacggcaaggattacatcgccctgaacgaggacctgagctcctggac cgcggcggacaccgcggctcagatcacccagcgcaagtgggaggcggcccgtgtggcggagcagctgagagcctacctgg agggcCTgtgcgtggagtggctccgcagatacctggagaacgggaaggagacgctgcagcgcgcGg

B*3527

(SEQ ID NO: 1371)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatctTcaagaccaacAcacagacttaccgagagaAcctgcggaacc tgcgcggctactacaaccagagcgaggccgggtctcacatcAtccagaggatgtaTggctgcgacCtggggccCgacggg cgcctcctccgcgggcatgaccagtCcgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgCagcgcgcGg

B*3528

(SEQ ID NO: 1372)

atgcgggtcacggcgccccgaaccgtcctcctgctgctctgggggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggaCggagccccgggcgccAtggatagagcaggaggg ccggagtattgggaccgggaGacacagatctCcaagaccaacAcacagactTaccgagagagcctgcggaacctgcgcgg ctactacaaccagagcgaggccgggtctcacatcAtccagaggatgtaTggctgcgacCtggggccCgacgggcgcctcc tccgcgggcatgaccagtCcgcctacgacggcaaggattacatcgccctgaacgaggacctgAgctcctggaccgcggcg gacacCgcggctcagatcacccagcgcaagtgggaggcggcccgtgTggcggagcagcTgagagcctacctggagggccT gtgcgtggagtggctccgcagatacctggagaacgggaaggagacgctgCagcgcgcGg

B*3529

(SEQ ID NO: 1373)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccCgggcgccAtggatagagca ggaggggccggagtattgggaccggaacacacagatctTcaagaccaacAcacagactgaccgagagagcctgcggaacc tgcgcggctactacaaccagagcgaggccgggtctcacatcAtccagaggatgtaTggctgcgacCtggggccCgacggg cgcctcctccgcgggcatgaccagtCcgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgCagcgcgcGg

B*3530

(SEQ ID NO: 1374)

gctcccactccatgaggtatttctacaccgccatgtcccggcccggccgcggggagccccgcttcatcgcagtgggctac gtggacgacacccagttcgtgaggttcgacagcgacgccgcgagtccgaggacaggagccCgggcgccAtggatagagca ggaggggccggagtattgggaccggaacacacagatctTcaagaccaacAcacagactTaccgagagagcctgcggaacc tgcgcggctactacaaccagagcgaggccgggtctcacatcAtccagaggatgtaTggctgcgacCtggggccCgacggg cgcctcctccgcgggcatgaccagtCcgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgCagcgcgcGg

B*3531

(SEQ ID NO: 1375)

atgcgggtcacggcgccccgaaccgtcctcctgctgctctgggggggcaGtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggacggagccCgggcgccatggatagagcaggaggggg ccggagtattgggaccggaacacacagatctacaaggcccaggcacagactgaccgagagagcctgcggaacctgcgcgg -continued

```
ctactacaaccagagcgaggccgggtctcacaccctccagagcatgtacggctgcgacgtggggccggacgggcgcctcc tccgcgggcatAaccagtacgcctacgacggcaaggattacatcgccctgaacgaggacctgcgctcctggaccgccgcg gacacggcggctcagatcacccagcgcaagtgggaggcggcccgtgTggcggagcagcTgagagcctacctggagggcga gtgcgtggagtggctccgcagatacctggagaacgggaaggagacgctgcagcgcgcggaccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagataagaaccttccagaa gtgggcagctgtggtggtgccttctggagaagagcagagatacacatgccatgtacagcatgagggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga
```

B*3532

(SEQ ID NO: 1376)
```
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccCcgggcgccAtggatagagca ggaggggccggagtattgggaccggaacacacagatctTcaagaccaacAcacagactTaccgagagagcctgcggaacc tgcgcggctactacaaccagagcgaggccgggtctcacaccctccagagGatgtacggctgcgacgtggggccCgacggg cgcctcctccgcgggcatgaccagtCcgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgCagcgcgcGg
```

B*3533

(SEQ ID NO: 1377)
```
tgaccgagacctgggccggctcccactccatgaggtatttctacaccgccatgtcccggcccggccgcggggagccccgc ttcatcgcagtgggctacgtggacgacacccagttcgtgaggttcgacagcgacgccgcgagtccgaggacggagccccg ggcgccatggatagagcaggaggggccggagtattgggaccggaacacacagatctTcaagaccaacacacagactTacc gagagagcctgcggaacctgcgcggctactacaaccagagcgaggccgggtctcacatcatccagaggatgtatggctgc gacctggggccCgacgggcgcctcctccgcgggcatgaccagtTcgcctacgacggcaaggattacatcgccctgaacga ggacctgAgctcctggaccgcggcggacacCgcggctcagatcacccagcgcaagtgggaggcggcccgtgTggcggagc agcTgagagcctacctggagggcgagtgcgtggagtggctccgcagatacctggagaacgggaaggagacgctgCagcgc gcGg
```

B*3534

(SEQ ID NO: 1378)
```
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccCcgggcgccAtggatagagca ggaggggccggagtattgggaccggaacacacagatctTcaagaccaacAcacagactTaccgagagagcctgcggaacc tgcgcggctactacaaccagagcgaggccgggtctcacatcAtccagaggatgtaTggctgcgacCtggggccCgacggg cgcctcctccgcgggcatgaccagtacgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgCagcgcgcGg
```

B*3535

(SEQ ID NO: 1379)
```
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagagcctgcggaacc tgcgcggctactacaaccagagcgaggccgggtctcacatcatccagaggatgtatggctgcgacctggggcccgacggg cgcctcctccgcgggcatgaccagtCcgcctacgacggcaaggattacatcgccctgaacgaggacctgagctcctggac
```

B*3536

(SEQ ID NO: 1380)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagagcctgcggaacc tgcgcgActactacaaccagagcgaggcccgggtctcacatcatccagaggatgtatggctgcgacctggggcccgacggg cgcctcctccgcgggcatgaccagttcgcctacgacggcaaggattacatcgccctgaacgaggacctgagctcctggac cgcggcggacaccgcggctcagatcacccagcgcaagtgggaggcggcccgtgtggcggagcagctgagagcctacctgg agggcctgtgcgtggagtggctccgcagatacctggagaacgggaaggagacgctgcagcgcgcgg

B*3537

(SEQ ID NO: 1381)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagagcctgcggaacc tgcgcggctactacaaccagagcgaggcccgggtctcacacttggcagaCgatgtaTggctgcgacCtggggccCgacggg cgcctcctccgcgggcatgaccagtCcgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgCagcgcgcG

B*3538

(SEQ ID NO: 1382)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagagcctgcggaacc tgcgcggctactacaaccagagcgaggcccgggtctcacatcAtccagaggatgtatggctgcgacctggggcccgacggg cgcctcctccgcgggcatgaccagtTcgcctacgacggcaaggattacatcgccctgaacgaggacctgagctcctggac cgcggcggacacCgcggctcagatcacccagcgcaagtgggaggcggcccgtgTggcggagcaggaCagagcctacctgg agggccTgtgcgtggagtggctccgcagatacctggagaacgggaaggaGacgctgCagcgcgcG

B*3539

(SEQ ID NO: 1383)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccCcgggcgccAtggatagagca ggaggggccggagtattgggaccggaacacacagatctTcaagaccaacAcacagactTaccgagagagcctgcggaacc tgcgcggctactacaaccagagcgaggcccgggtctcacaTcatccagagGatgtacggctgcgacgtggggccgacggg cgcctcctccgcgggcatgaccagtacgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgcagcgcgcGg

B*3541

(SEQ ID NO: 1384)

gggggcagtggccctgaccgagacctgggccggctcccactccatgaggtatttctacaccgccatgtcccggcccggcc gcggggagccccgcttcatcgcagtgggctacgtggacgacacccagttcgtgaggttcgacagcgacgccgcgagtccg aggacggagccccgggcgccatggatagagcaggaggggccggagtattgggaccggaacacacagatcttcaagaccaa cacacagacttaccgagagagcctgcggaacctgcgcggctactacaaccagagcgaggcccgggtctcacatcatccaga ggatgtatggctgcgacctggggcccgacgggcgcctcctccgcgggcatgaccagtccgcctGcgacggcaaggattac -continued atcgccctgaacgaggacctgagctcctggaccgcggcggacaccgcggctcagatcacccagcgcaagtgggaggcggc ccgtgtggcggagcagctgagagcctacctggagggcctgtgcgtggagtggctccgcagatacctggagaacgggaagg agacgctgcagcgcgcggacccccaaagacacacgtgacccaccacccgtctctgaccatgaggccaccctgaggtgc tgggccctgggcttctaccctgcggagatcacactgacctggcagcgggatggcgaggaccaaactcaggacactgagct tgtggagaccagaccagcaggagatagaaccttccagaagtgggcagctgtggtggtgccttctggagaagagcagagat acacatgccatgtacagcatgaggggctgccgaagcccctcaccctgagatgggagccatcttcccagtccaccatcccc atcgtgggcattgttgctggcctggctgtcct

B*3542

(SEQ ID NO: 1385)
atgcgggtcacggcgccccgaaccctcctcctgctgctctgggggcagtggccctgaccgagacctgggcTggctccca ctccatgaggtatttctacaccgccatgtcccggcccggccgcggggagccccgcttcatcgcagtgggctacgtggacg acacccagttcgtgaggttcgacagcgacgccgcgagtccgaggacggagccccgggcgccatggatagagcaggagggg ccggagtattgggaccggaacacacagatcttcaagaccaacacacagacttaccgagagagcctgcggaacctgcgcgg ctactacaaccagagcgaggccgggtctcacatcatccagaggatgtatggctgcgacctggggcccgacgggcgcctcc tccgcgggcatgaccagtccgcctacgacggcaaggattacatcgccctgaacgaggacctgagctcctggaccgcggcg gacaccgcggctcagatcacccagcgcaagtgggaggcggcccgtgtggcggagcagctgagagcctacctggagggcct gtgcgtggagtggctccgcagatacctggagaacgggaaggagacgctgcagcgcgcggacccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcag

B*3543

(SEQ ID NO: 1386)
atgcgggtcacggcgccccgaaccgtcctcctgctgctctgggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggaCggagccccgggcgccatggatagagcaggagggg ccggagtattgggaccggaacacacagatctTcaagaccaacacacagactTaccgagagagcctgcggaacctgcgcgg ctactacaaccagagcgaggccgggtctcacaccctccagagGatgtacggctgcgacgtggggccggacgggcgcctcc tccgcgggcatgaccagtccgcctacgacggcaaggattacatcgccctgaacgaggacctgagctcctggaccgcggcg gacacgcggctcagatcacccagcgcaagtgggaggcggcccgtgaggcggagcagTggagagcctacctggagggcct gtgcgtggagtggctccgcagatacctggagaacgggaaggagacgctgcagcgcgcggacccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*3544

(SEQ ID NO: 1387)
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggagggggccggagtattgggaccggaacacacagatctTcaagaccaacacacagacttaccgagagagcctgcggaacc tgcgcggctactacaaccagagcgaggccgggtctcacaccctccagaggatgtacggctgcgacgtggggccggacggg cgcctcctccgcgggcatAaccagtacgcctacgacggcaaggattacatcgccctgaacgaggacctgagctcctggac cgcGgcggacacggcggctcagatcacccagcgcaagtgggaggcggcccgtgaggcggagcagTggagagcctacctgg agggccTgtgcgtggagtggctccgcagatacctggagaacgggaaggagacgctgcagcgcgcGg

B*3545

(SEQ ID NO: 1388)

gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagagcctgcggaacc tgcgcggctactacaaccagagcgaggccgggtctcacatcAtccagaggatgtatggctgcgacctggggccCgacggg cgcctcctccgcgggcatgaccagtCcgcctacgacggcaaggattacatcgccctgaacgaggacctgagctcctggac cgcggcggacacCgcggctcagatcacccagcgcaagtgggaggcggcccgtgTggcggagcagcggagagcctacctgg agggccTgtgcgtggagtCgctccgcagatacctggagaacgggaaggagacgctgcagcgcgcGg

B*3701

(SEQ ID NO: 1389)

atgcgggtcacggcgccccgaaccctcctcctgctgctctgggggcagtggccctgaccgagacctgggctggctccca ctccatgaggtatttccacacctccgtgtcccggcccggccgcggggagccccgcttcatctcagtgggctacgtggacg acacccagttcgtgaggttcgacagcgacgccgcgagtccgaggacggagccccgggcgccgtggatagagcaggagggg ccggagtattgggaccgggagacacagatctccaagaccaacacacagacttaccgagaggacctgcggaccctgctccg ctactacaaccagagcgaggccgggtctcacaccatccagaggatgtCtggctgcgacgtggggccggacgggcgcctcc tccgcgggtataaccagttcgcctacgacggcaaggattacatcgccctgaacgaggacctgagctcctggaccgcggcg gacaccgcggctcagatcacccagcgcaagtgggaggcggccgtgtggcggagcaggacagagcctacctggagggcac gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*3702

(SEQ ID NO: 1390)

atgcgggtcacggcgccccgaaccctcctcctgctgctctgggggcagtggccctgaccgagacctgggctggctccca ctccatgaggtatttccacacctccgtgtcccggcccggccgcggggagccccgcttcatctcagtgggctacgtggacg acacccagttcgtgaggttcgacagcgacgccgcgagtccgaggacggagccccgggcgccgtggatagagcaggagggg ccggagtattgggaccgggagacacagatctccaagaccaacacacagactTaccgagagGacctgcggaccctgctccg ctactacaaccagagcgaggccgggtctcacaccctccagaaTatgtatggctgcgacgtggggccggacgggcgcctcc tccgcgggtaccaccagGacgcctacgacggcaaggattacatcgccctgaacgaggacctgAgctcctggaccgccgcg gacacggcggctcagatcacccagcgcaagtgggaggcggcccgtgtggcggagcagcTgagagcctacctggagggcga gtgcgtggagtggctccgcagatacctggagaacgggaaggagacgctgcagcgcgcggaccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*3704

(SEQ ID NO: 1391)

atgcgggtcacggcgccccgaaccctcctcctgctgctctgggggcagtggccctgaccgagacctgggctggctccca ctccatgaggtatttccacacctccgtgtcccggcccggccgcggggagccccgcttcatctcagtgggctacgtggacg acacccagttcgtgaggttcgacagcgacgccgcgagtccgaggacggagccccgggcgccgtggatagagcaggagggg ccggagtattgggaccgggagacacagatctccaagaccaacacacagacttaccgagaggacctgcggaccctgctccg ctactacaaccagagcgaggccgggtctcacaccatccagaggatgtCtggctgcgacgtggggccggacgggcgcctcc tccgcgggtataaccagttcgcctacgacggcaaggattacatcgccctgaacgaggacctgagctcctggaccgcggcg gacaccgcggctcagatcacccagcgcaagtgggaggcggcccgtgtggcggagcaggacagagcctacctggagggcac gtgcgtggagtggctccgcagaCacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*3705

(SEQ ID NO: 1392)

atgcgggtcacggcgccccgaaccctcctcctgctgctctgggggcagtggccctgaccgagacctgggctggctccca ctccatgaggtatttccacacctccgtgtcccggcccggccgcggggagccccgcttcatctcagtgggctacgtggacg acacccagttcgtgaggttcgacagcgacgccgcgagtccgaggacggagccccgggcgccgtggatagagcaggagggg ccggagtattgggaccgggagacacagatctccaagaccaacacacagacttaccgagaggacctgcggaacctgcgcgg ctactacaaccagagcgaggccgggtctcacaccatccagaggatgtCtggctgcgacgtggggccggacgggcgcctcc tccgcgggtataaccagttcgcctacgacggcaaggattacatcgccctgaacgaggacctgagctcctggaccgcggcg gacaccgcggctcagatcacccagcgcaagtgggaggcggcccgtgtggcggagcaggaCagagcctacctggagggcaC gtgcgtggagtggctccgcagatacctggagaacgggaaggagacgctgcagcgcgcgg

B*3801

(SEQ ID NO: 1393)

atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggaatattgggaccggaacacacagatctgcaagaccaacacacagacttaccgagagaacctgcggaTcgcgctcCg ctactacaaccagagcgaggccgggtctcacaccctccagagGatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagcTgagaAcctacctggagggcac gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga

B*380201

(SEQ ID NO: 1394)

atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg

```
acacgcagttcgtgaggttcgacagcgacgccgcgagtccgagagaggagccgcgggcgccgtggatagagcaggagggg ccggaatatttgggaccggaacacacagatctgcaagaccaacacacagacttaccgagagaacctgcgcaCcgcgctcCg ctactacaaccagagcgaggccgggtctcacaccctccagagGatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagcTgagaAcctacctggagggcac gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga B*380202                                                         (SEQ ID NO: 1395)
gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggaatatttgggaccggaacacacagatctgcaagaccaacacacagacttaccgagagaacctgcgcaccg cgctccgctactacaaccagagcgaggccgggtctcacaccctccagaggatgtacggctgcgacgtggggccggacggg cgcctcctccgcgggcataaccagttcgcctacgacggcaaggattacatcgccctgaacgaggacctgagctcctggac Agcggcggacaccgcggctcagatcacccagcgcaagtgggaggcggcccgtgtggcggagcagctgagaacctacctgg agggcacgtgcgtggagtggctccgcagatacctggagaacgggaaggagacgctgcagcgcgcgg B*3803                                                           (SEQ ID NO: 1396)
gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggaAtatttgggaccgggagacacagatctCcaagaccaacacacagactgaccgagagagcctgcgcaCcg cgctcCgctactacaaccagagcgaggccgggtctcacaccctccagagGatgtacggctgcgacgtggggccggacggg cgcctcctccgcgggcatAaccagtTcgcctacgacggcaaggattacatcgccctgaacgaggacctgagctcctggac cgcggcggacaccgcggctcagatcacccagcgcaagtgggaggcggcccgtgtggcggagcagcTgagaAcctacctgg agggcaCgtgcgtggagtggctccgcagatacctggagaacgggaaggagacgctgcagcgcgcGg B*3804                                                           (SEQ ID NO: 1397)
gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtatttgggacccgggaGacacagatctgcaagaccaacacacagacttaccgagagaAcctgcgcaCcg cgctcCgctactacaaccagagcgaggccgggtctcacaccctccagagGatgtacggctgcgacgtggggccggacggg cgcctcctccgcgggcatAaccagtTcgcctacgacggcaaggattacatcgccctgaacgaggacctgagctcctggac cgcggcggacaccgcggctcagatcacccagcgcaagtgggaggcggcccgtgTggcggagcagcTgagaAcctacctgg agggcaCgtgcgtggagtggctccgcagatacctggagaacgggaaggagacgctgcagcgcgcGg B*3805                                                           (SEQ ID NO: 1398)
gctcccactccatgaggtatttctacaccGccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggaatatttgggaccggaacacacagatctgcaagaccaacacacagacttaccgagagaacctgcggaTcg cgctcCgctactacaaccagagcgaggccgggtctcacaccctccagagGatgtacggctgcgacgtggggccggacggg cgcctcctccgcgggcataaccagttcgcctacgacggcaaggattacatcgccctgaacgaggacctgagctcctggac
```

-continued cgcggcggacaccgcggctcagatcacccagcgcaagtgggaggcggcccgtgtggcggagcagcTgagaAcctacctgg agggcacgtgcgtggagtggctccgcagatacctggagaacgggaaggagacgctgcagcgcgcggacccccaaagaca catgtgacccaccacccatctctgaccatgaggccaccctgaggtgctgggccctgggcttctaccctgcggagatcac actgacctggcagcgggatggcgaggaccaaactcaggacaccgagcttgtggagaccagaccagcaggagaCagaacct tccagaagtgggcagctgtggtggtgccttctggagaagagcagagatacacatgccatgtacagcatgaggggctgccg aagcccctcaccctgagatggg

B*3806 (SEQ ID NO: 1399)

gctcccactccatgaggtatttctacacctccgtgtcccggcccggccgcggggagccccgcttcatctcagtgggctac gtggacgacacgcagttcgtgaggttcgacagcgacgccgcgagtccgaggacggagccccgggcgccatggatagagca ggaggggccggagtattgggaccggaacacacagatctTcaagaccaacacacagacttaccgagagaacctgcggaTcg cgctcCgctactacaaccagagcgaggccgggtctcacaccctccagagGatgtacggctgcgacgtggggccggacggg cgcctcctccgcgggcatAaccagtTcgcctacgacggcaaggattacatcgccctgaacgaggacctgagctcctggac cgcggcggacaccgcggctcagatcacccagcgcaagtgggaggcggcccgtgTggcggagcagcTgagaAcctacctgg agggcaCgtgcgtggagtggctccgcagatacctggagaacgggaaggagacgctgcagcgcgcGg

B*3807 (SEQ ID NO: 1400)

gctcccactccatgaggtatttctacacctccgtgtcccggcccggccgcggggagccccgcttcatctcagtgggctac gtggacgacacgcagttcgtgaggttcgacagcgacgccgcgagtccgaggacggagccccgggcgccatggatagagca ggaggggccggGatattgggaccggaacacacagatcttcaagaccaacacacagacttaccgagagaacctgcggatcg cgctccgctactacaaccagagcgaggccgggtctcacaccctccagaggatgtacggctgcgacgtggggccggacggg cgcctcctccgcgggcataaccagttcgcctacgacggcaaggattacatcgccctgaacgaggacctgagctcctggac cgcggcggacaccgcggctcagatcacccagcgcaagtgggaggcggcccgtgtggcggagcagctgagaacctacctgg agggcacgtgcgtggagtggctccgcagatacctggagaacgggaaggagacgctgcagcgcgcgg

B*3808 (SEQ ID NO: 1401)

gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggaAtattgggaccggaacacacagatctgcaagaccaacacacagacttaccgagagaacctgcgcaccg cgctccgctactacaaccagagcgaggccgggtctcacaccctccagaggatgtacggctgcgacgtggggccggacggg cgcctcctccgcgggcataaccagttcgcctacgacggcaaggattacatcgccctgaacgaggacctgagctcctggac cgcggcggacaccgcggctcagatcacccagcgcaagtgggaggcggcccgtgtggcggagcagctgagaacctacctgg agggcATgtgcgtggagtggctccgcagatacctggagaacgggaaggagacgctgcagcgcgcGg

B*3809 (SEQ ID NO: 1402)

gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggaatattgggaccggaacacacagatctgcaagaccaacacacagacttaccgagagaacctgcggatcg cgctccgctactacaaccagagcgaggccgggtctcacaccctccagaggatgtacggctgcgacgtggggccggacggg cgcctcctccgcgggcataaccagttcgcctacgacggcaaggattacatcgccctgaacgaggacctgagctcctggac cgcggcggaGaccgcggctcagatcacccagcgcaagtgggaggcggcccgtgtggcggagcagctgagaacctacctgg agggcacgtgcgtggagtggctccgcagatacctggagaacgggaaggagacgctgcagcgcgcg -continued B*390101
(SEQ ID NO: 1403)
atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggaccgcgggcgccgtggatagagcaggagggg ccggaatattgggaccggaacacacagatctGcaagaccaacAcacagactgaccgagagagcctgcggaacctgcgcgg ctactacaaccagagcgaggccgggtctcacaccctccagagGatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagcTgagaAcctacctggagggcac gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtcccta...gca gttgtggtcatcggagctgtggtcgctgctgtgatgtgtaggaggaagagttcaggtgga B*390103
(SEQ ID NO: 1404)
atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggaatattgggaccggaacacacagatctGcaagaccaacacacagactgaccgagagagcctgcggaacctgcgcgg ctactacaaccagagcgaggccgggtctcacaccctccagaggatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagctgagaacctacctggagggcac gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccatcttcccagtccaccgtccccatcgtgggcattgttgctggcctggctgtcccta...gca gttgtggtcatcggagctgtggtcgctgctgtgatgtgtaggaggaagagCtcaggtgga B*390104
(SEQ ID NO: 1405)
gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccAgaatattgggaccggaacacacagatctgcaagaccaacacacagactgaccgagagagcctgcggaacc tgcgcggctactacaaccagagcgaggccgggtctcacaccctccagaggatgtacggctgcgacgtggggccggacggg cgcctcctccgcgggcataaccagttcgcctacgacggcaaggattacatcgccctgaacgaggacctgagctcctggac cgcggcggacaccgcggctcagatcacccagcgcaagtgggaggcggcccgtgtggcggagcagctgagaacctacctgg agggcacgtgcgtggagtggctccgcagatacctggagaacgggaaggagacgctgcagcgcgcgg B*390201
(SEQ ID NO: 1406)
atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg -continued ccggaatatttgggaccggggagacacagatctCcaagaccaacacacagactgaccgagagagcctgcggaacctgcgcgg ctactacaaccagagcgaggccgggtctcacaccctccagaggatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagctgagaacctacctggagggcac gtgcgtggagtggctccgcagatacctggagaacgggaaggagacgctgcagcgcgcggacccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccatcttcccagtccaccgtccccatcgtgggcattgttgctggcctggctgtccta...gca gttgtggtcatcggagctgtggtcgctgctgtgatgtgtaggaggaagagCtcaggtgga B*390202
(SEQ ID NO: 1407)
atgctggtcatggcgcccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggagtatttgggaccgggagacacagatctCcaagaccaacAcacagactgaccgagagagcctgcggaacctgcgcgg ctactacaaccagagcgaggccgggtctcacaccctccagagGatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagcTgagaAcctacctggagggcac gtgcgtggagtggctccgcagatacctggagaacgggaaggagacgctgcagcgcgcggacccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga B*3903
(SEQ ID NO: 1408)
gtcctcctgctgctctcggcggccctggccctgaccgagacctgggccggctcccactccatgaggtatttctacacctc cgtgtcccggcccggccgcggggagccccgcttcatctcagtgggctacgtggacgacacgcagttcgtgaggttcgaca gcgacgccgcgagtccgagagaggagccgcgggcgccgtggatagagcaggagggggccggaatatttgggaccggaacaca cagatctGcaagaccaacAcacagactgaccgagagagcctgcggaacctgcgcggctactacaaccagagcgaggccgg gtctcacaccctccagagcatgtacggctgcgacgtggggccggacgggcgcctcctccgcgggcataaccagttcgcct acgacggcaaggattacatcgccctgaacgaggacctgagctcctggaccgcggcggacaccgcggctcagatcacccag cgcaagtgggaggcggcccgtgtggcggagcagcTgagaAcctacctggagggcacgtgcgtggagtggctccgcagata cctggagaacgggaaggagacgctgcagcgcgcggacccccccaaagacacatgtgacccaccaccccatctctgaccatg aggccaccctgaggtgctgggccctgggcttctaccctgcggagatcacactgacctggcagcgggatggcgaggaccaa actcaggacaccgagcttgtggagaccagaccagcaggagaCagaaccttccagaagtgggcagctgtggtggtgccttc tggagaagagcagagatacacatgccatgtacagcatgaggggctgccgaagcccctcaccctgagatgggagccAtctt cccagtccaccgtccccatcgtgggcattgttgctggcctggctgtccta...gcagttgtggtcatcggagctgtggtc gctgctgtgatgtgtaggaggaagagttcaggtgga B*3904
(SEQ ID NO: 1409)
atgctggtcatggcgcccgaaccgtcctcctgctgctctcggcggccctggccctgaccgagacctgggccggctcccca ctccatgaggtatttctacacaccgccAtgtcccggcccggccgcggggagccccgcttcatctcagtgggctacgtggacg -continued acacgcagttcgtgaggttcgacagcgacgccgcgagtccgagagaggagccgcgggcgccgtggatagagcaggagggg ccggaatatgggaccggaacacacagatctGcaagaccaacAcacagactgaccgagagagcctgcggaacctgcgcgg ctactacaaccagagcgaggccgggtctcacaccctccagagGatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagcTgagaAcctacctggagggcac gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga

B*3905

(SEQ ID NO: 1410)

atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggaatatgggaccggaacacacagatctgcaagaccaacacacagactTaccgagagagcctgcggaacctgcgcgg ctactacaaccagagcgaggccgggtctcacaccctccagagGatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagcTgagaAcctacctggagggcac gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga

B*390601

(SEQ ID NO: 1411)

atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggaatatgggaccggaacacacagatctgcaagaccaacacacagactgaccgagagagcctgcggaacctgcgcgg ctactacaaccagagcgaggccgggtctcacacttggcagaCGatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagcTgagaAcctacctggagggcac gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga

B*390602

(SEQ ID NO: 1412)
atgctggtcatggcgcccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggaatattgggaccggaacacacagatctgcaagaccaacacacagactgaccgagagagcctgcggaacctgcgcgg ctactacaaccagagcgaggccgggtctcacacttggcagaCgatgtaTggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagcTgagaAcctacctggagggcac gtgcgtggagtggctccgcagatacctggagaacgggaaggagacgctgcagcgcgcggacccccccaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga

B*3907

(SEQ ID NO: 1413)
ggttcgacagcgacgccgcgagtccgagagaggagccgcgggcgccgtggatagagcaggaggggccggaAtattgggac cggaacacacagatctgcaagaccaacacacagacttaccgagagagcctgcggaacctgcgcggctactacaaccagag cgaggccgggtctcacaccctccagaggatgtacggctgcgacgtggggccggacgggcgcctcctccgcgggcatgacc agtCcgcctacgacggcaaggattacatcgccctgaacgaggacctgagctcctggaccgcggcggacaccgcggctcag atcacccagcgcaagtgggaggcggcccgtgtggcggagcagcTgagaAcctacctggagggcaCgtgcgtggagtggct ccgcagatacctg

B*3908

(SEQ ID NO: 1414)
atgctggtcatggcgcccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggaatattgggaccgggagacacagatctCcaagaccaacacacagactTaccgagagagcctgcggaacctgcgcgg ctactacaaccagagcgaggccgggtctcacaccctccagagGatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagcggagaAcctacctggagggcac gtgcgtggagtggctccgcagatacctggagaacgggaaggagacgctgcagcgcgcggacccccccaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga

B*3909

(SEQ ID NO: 1415)
atgctggtcatggcgcccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggaatattgggaccggaacacacagatctgcaagaccaacacacagactgaccgagagagcctgcggaacctgcgcgg -continued ctactacaaccagagcgaggccgggtctcacaccctccagagGatgtCtggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagctgagaacctacctggagggcac gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga B*3910
(SEQ ID NO: 1416)
atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggagtattgggaccggaacacacagatctacaagaccaacAcacagactgaccgagagagcctgcggaacctgcgcgg ctactacaaccagagcgaggccgggtctcacaccctccagagGatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagcTgagaAcctacctggagggcac gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga B*3911
(SEQ ID NO: 1417)
tacacctccgtgtcccggcccggccgcggggagccccgcttcatctcagtgggctacgtggacgacacgcagttcgtgag gttcgacagcgacgccgcgagtccgagagaggagccgcgggcgccgtggatagagcaggaggggccggaAtattgggacc ggaacacacagatctGcaagaccaacacacagactTaccgagagagcctgcggaacctgcgcggctactacaaccagagc gaggccgggtctcacaccctccagagGatgtacggctgcgacgtggggccggacgggcgcctcctccgcgggcataacca gttcgcctacgacggcaaggattacatcgccctgaacgaggacctgagctcctggaccgcggcggacaccgcggctcaga tcacccagcgcaagtgggaggcggcccgtgtggcggagcagcggagaAcctacctggagggcacgtgcgtggagtggctc cgcagatacctggagaacgggaaggagacgctgcagcgcgcggaccccccaaagacacatgtgacccaccaccccatctc tgaccatgaggccaccctgaggtgctgggccctgggcttctaccctgcggagatcacactgacctggcagcgggatggcg aggaccaaactcaggacacCgagcttgtggagaccag B*3912
(SEQ ID NO: 1418)
gctcccactccatgaggtatttcgacaccgccgtgtcccggcccggccgcgcggAgagccccgcttcatctcagtgggctac gtggacgacacgcagttcgtgaggttcgacagcgacgccgcgagtccgagagaggagccgcgggcgccgtggatagagca ggaggggccggaatattgggaccggaacacacagatctgcaagaccaacacacagactgaccgagagagcctgcggaacc tgcgcggctactacaaccagagcgaggccgggtctcacaccctccagaggatgtacggctgcgacgtggggccggacggg cgcctcctccgcgggcataaccagttcgcctacgacggcaaggattacatcgccctgaacgaggacctgagctcctggac cgcggcggacaccgcggctcagatcacccagcgcaagtgggaggcggcccgtgtggcggagcagctgagaacctacctgg agggcacgtgcgtggagtggctccgcagatacctggagaacgggaaggagacgctgCagcgcgcgg B*3913
(SEQ ID NO: 1419)
gctcccactccatgaggtatttctacacctccgtgtcccggcccggccgcggggagccccgcttcatctcagtgggctac
gtggacgacacgcagttcgtgaggttcgacagcgacgccgcgagtccgagagaggagccgcgggcgccgtggatagagca
ggaggggccggagtattgggaccgggagacacagatctCcaagaccaacacacagactTaccgagagagcctgcggaacc
tgcgcggctactacaaccagagcgaggccgggtctcacaccctccagagGatgtacggctgcgacgtggggccggacggg
cgcctcctccgcgggcatAaccagtTcgcctacgacggcaaggattacatcgccctgaacgaggacctgagctcctggac
cgcggcggacaccgcggctcagatcacccagcgcaagtgggaggcggcccgtGgcggagcagcTgagaAcctacctgg
agggcaCgtgcgtggagtggctccgcagatacctggagaacgggaaggagacgctgcagcgcgcGg B*3914
(SEQ ID NO: 1420)
gctcccactccatgaggtatttctacacctccgtgtcccggcccggccgcggggagccccgcttcatctcagtgggctac
gtggacgacacgcagttcgtgaggttcgacagcgacgccgcgagtccgagagaggagccgcgggcgccgtggatagagca
ggaggggccggaAtattgggaccggaacacacagatctGcaagaccaacAcacagactgaccgagagagcctgcggaacc
tgcgcggctactacaaccagagcgaggccgggtctcacaccctccagagcatgtacggctgcgacgtggggccggacggg
cgcctcctccgcgggcatAaccagtacgcctacgacggcaaggattacatcgccctgaacgaggacctgagctcctggac
cgcggcggacaccgcggctcagatcacccagcgcaagtgggaggcggcccgtgtggcggagcagcTgagaAcctacctgg
agggcaCgtgcgtggagtggctccgcagatacctggagaacgggaaggagacgctgcagcgcgcGg B*3915
(SEQ ID NO: 1421)
gctcccactccatgaggtatttctacacctccgtgtcccggcccggccgcggggagccccgcttcatctcagtgggctac
gtggacgacacgcagttcgtgaggttcgacagcgacgccgcgagtccgagagaggagccgcgggcgccgtggatagagca
ggaggggccggaAtattgggaccggaacacacagatctGcaagaccaacAcacagactgaccgagagagcctgcggaacc
tgcgcggctactacaaccagagcgaggccgggtctcacaccctccagagGatgtacggctgcgacgtggggccggacggg
cgcctcctccgcgggcatgaccagtTcgcctacgacggcaaggattacatcgccctgaacgaggacctgagctcctggac
cgcggcggacaccgcggctcagatcacccagcgcaagtgggaggcggcccgtgtggcggagcagcTgagaAcctacctgg
agggcaCgtgcgtggagtggctccgcagatacctggagaacgggaaggagacgctgcagcgcgcGg B*3916
(SEQ ID NO: 1422)
gctcccactccatgaggtatttctacacctccgtgtcccggcccggccgcggggagccccgcttcatctcagtgggctac
gtggacgacacgcagttcgtgaggttcgacagcgacgccgcgagtccgagagaggagccgcgggcgccgtggatagagca
ggaggggccggagtattgggaccggaacacacagatctacaagaccaacacacagactgaccgagagagcctgcggaacc
tgcgcggctactacaaccagagcgaggccgggtctcacaccctccaCaggatgtacggctgcgacgtggggccggacggg
cgcctcctccgcgggcataaccagttcgcctacgacggcaaggattacatcgccctgaacgaggacctgagctcctggac
cgcggcggacaccgcggctcagatcacccagcgcaagtgggaggcggcccgtgtggcggagcagctgagaacctacctgg
agggcacgtgcgtggagtggctccgcagatacctggagaacgggaaggagacgctgcagcgcgcgg B*3917
(SEQ ID NO: 1423)
atgctggtcatggcgccccgaaccgtcctcctgctgctctcggcggccctggccctgaccgagacctgggccggctccca
ctccatgaggtatttctacacctccgtgtcccggcccggccgcggggagccccgcttcatctcagtgggctacgtggacg
acacgcagttcgtgaggttcgacagcgacgccgcgagtccgagagaggagccgcgggcgccgtggatagagcaggagggg
ccggagtattgggaccggaacacacagatctacaagaccaacacacagactgaccgagagagcctgcggaacctgcgcgg
ctactacaaccagagcgaggccgggtctcacaccctccagaggatgtacggctgcgacgtggggccggacggggcgcctcc
tccgcgggtataaccagttAgcctacgacggcaaggattacatcgccctgaacgaggacctgagctcctggaccgcggcg -continued gacaccgcggctcagatcacccagcgcaagtgggaggcggcccgtgtggcggagcagctgagaAcctacctggagggcaC gtgcgtggagtggctccgcagatacctggagaacgggaaggagacgctgcagcgcgcGg

B*3918

(SEQ ID NO: 1424)

gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggaAtattgggaccggaacacacagatctgcaagaccaacacacagactgaccgagagagcctgcggaacc tgcgcggctactacaaccagagcgaggccgggtctcacaccctccagaggatgtacggctgcgacgtggggccggacggg cgcctcctccgcgggcataaccagttcgcctacgacggcaaggattacatcgccctgaacgaggacctgagctcctggac cgcggcggacacggcggctcagatcacccagcgcaagtgggaggcggcccgtgaggcggagcagTgagaAcctacctgg agggcaCgtgcgtggagtggctccgcagatacctggagaacgggaaggagacgctgcagcgcgcGg

B*3919

(SEQ ID NO: 1425)

gctcccactccatgaggtatttctacacctccgtgtcccggcccggccgcggggagccccgcttcatctcagtgggctac gtggacgacacgcagttcgtgaggttcgacagcgacgccgcgagtccgaggacggagccccgggcgccAtggatagagca ggaggggccggagtattgggaccggaacacacagatctGcaagaccaacAcacagactgaccgagagagcctgcggaacc tgcgcggctactacaaccagagcgaggccgggtctcacaccctccagagGatgtacggctgcgacgtggggccggacggg cgcctcctccgcgggcatAaccagtTcgcctacgacggcaaggattacatcgccctgaacgaggacctgagctcctggac cgcggcggacaccgcggctcagatcacccagcgcaagtgggaggcggcccgtgTggcggagcagcTgagaAcctacctgg agggcaCgtgcgtggagtggctccgcagatacctggagaacgggaaggagacgctgcagcgcgcGg

B*3920

(SEQ ID NO: 1426)

gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatctacaagaccaacacacagacttaccgagagaAcctgcggaacc tgcgcggctactacaaccagagcgaggccgggtctcacaccctccagagGatgtacggctgcgacgtggggccggacggg cgcctcctccgcgggcatAaccagtTcgcctacgacggcaaggattacatcgccctgaacgaggacctgagctcctggac cgcggcggacaccgcggctcagatcacccagcgcaagtgggaggcggcccgtgTggcggagcagcTgagaAcctacctgg agggcaCgtgcgtggagtggctccgcagatacctggagaacgggaaggagacgctgcagcgcgcGg

B*3922

(SEQ ID NO: 1427)

gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggaAtattgggaccgggaDacacagatctGcaagaccaacAcacagactgaccgagagagcctgcggaacc tgcgcggctactacaaccagagcgaggccgggtctcacaccctccagagGatgtacggctgcgacgtggggccggacggg cgcctcctccgcgggcatAaccagtTcgcctacgacggcaaggattacatcgccctgaacgaggacctgagctcctggac cgcggcggacaccgcggctcagatcacccagcgcaagtgggaggcggcccgtgtggcggagcagcTgagaAcctacctgg agggcaCgtgcgtggagtggctccgcagatacctggagaacgggaaggagacgctgcagcgcgcGg

B*3923

(SEQ ID NO: 1428)

gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccgggagacacagatctccaagaccaacacacagactgaccgagagagcctgcggaacc tgcgcggctactacaaccagagcgaggccgggtctcacaccctccagaggatgtacggctgcgacgtggggccggacggg cgcctcctccgcgggcataaccagttcgcctacgacggcaaggattacatcgccctgaacgaggacctgagctcctggac -continued cgcggcggacaccgcggctcagatcacccGgcgcaagtgggaggcggcccgtgtggcggagcagctgagaacctacctgg agggcacgtgcgtggagtggctccgcagatacctggagaacgggaaggagacgctgcagcgcgcgg

B*3924 (SEQ ID NO: 1429)

atgctggtcatggcgcccgaaccgtcctcctgctgctctcggcggccctggccctgaccgagacctgggccggctccca ctccatgaggtatttctacacctccgtgtcccggcccggccgcggggagcccgcttcatctcagtgggctacgtggacg acacgcagttcgtgaggttcgacagcgacgccgcgagtccgagagaggagccgcgggcgccgtggatagagcaggaggg ccggaatattgggaccggaacacacagatctgcaagaccaacacacagactgaccgagagagcctgcggaacctgcgcgg ctactaaccagagcgaggccgggtctcacaccctccagagcaCgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagctgagaacctacctggagggcac gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagacagaaccttccagaa gtgggcagctgtggtggtgccttctggagaagagcagagatacacatgccatgtacagcatgaggggctgccgaagcccc tcaccctgagatgggagccatcttcccagtccaccgtccccatcgtgggcattgttgctggcctggctgtccta...gca gttgtggtcatcggagctgtggtcgctgctgtgatgtgtaggaggaagagttcaggtgga

B*3926 (SEQ ID NO: 1430)

gctcccactccatgaggtatttctacacctccgtgtcccggcccggccgcggggagcccgcttcatctcagtgggctac gtggacgacacgcagttcgtgaggttcgacagcgacgccgcgagtccgagagaggagccgcgggcgccgtggatagagca ggaggggccggaatattgggaccggaacacacagatctgcaagaccaacacacagactgaccgagagagcctgcggaacc tgcgcggctactacaaccagagcgaggccgggtctcacaccctccagaggatgtacggctgcgacgtggggccggacggg cgcctcctccgcgggcataaccagttcgcctacgacggcaaggattacatcgccctgaacgaggacctgagctcctggac cgcggcggacaccgcggctcagatcacccagcgcaagtgggaggcggcccTtgtggcggagcagctgagaacctacctgg agggcacgtgcgtggagtggctccgcagatacctggagaacgggaaggagacgctgcagcgcgcgg

B*3927 (SEQ ID NO: 1431)

gctcccactccatgaggtatttctacacctccgtgtcccggcccggccgcggggagcccgcttcatctcagtgggctac gtggacgacacgcagttcgtgaggttcgacagcgacgccgcgagtccgagagaggagccgcgggcgccgtggatagagca ggaggggccggaatattgggaccggaacacacagatctgcaagaccaacAcacagactgaccgagTgagcctgcggaacc tgcgcggctactacaaccagagcgaggccgggtctcacaccctccagaggatgtacggctgcgacgtggggccggacggg cgcctcctccgcgggcataaccagttcgcctacgacggcaaggattacatcgccctgaacgaggacctgagctcctggac cgcggcggacaccgcggctcagatcacccagcgcaagtgggaggcggcccgtgtggcggagcagctgagaAcctacctgg agggcaCgtgcgtggagtggctccgcagatacctggagaacgggaaggagacgctgCagcgcgcGg

B*400101 (SEQ ID NO: 1432)

atgcgggtcacggcaccccgaaccgtcctcctgctgctctcggcggccctggccctgaccgagacctgggcGggctccca ctccatgaggtatttccacaccgccatgtcccggcccggccgcggggagcccgcttcatcaccgtgggctacgtggacg acacgctgttcgtgaggttcgacagcgacgccacgagtccgaggaaggagccgcgggcgccatggatagagcaggaggg ccggagtattgggaccgggagacacagatctccaagaccaacacacagacttaccgagagagcctgcggaacctgcgcgg ctactacaaccagagcgaggccgggtctcacaccctccagaggatgtacggctgcgacgtggggccggacgggcgcctcc tccgcgggcataaccagtacgcctacgacggcaaggattacatcgccctgaacgaggacctgcgctcctggaccgccgcg gacacggcggctcagatctcccagcgcaagtgggaggcggcccgtgtggcggagcagctgagagcctacctggagggcga gtgcgtggagtggctccgcagatacctggagaacgggaaggacaagctggagcgcgctgacccccaaagacacacgtga -continued cccaccacccatctctgaccatgaggccaccctgaggtgctgggccctgggtttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagttcaggtgga

B*400102

(SEQ ID NO: 1433)

atgcgggtcacggcaccccgaaccgtcctcctgctgctctcggcggccctggccctgaccgagacctgggccggctccca ctccatgaggtatttcCacaccgccatgtcccggcccggccgcggggagccccgcttcatcaccgtgggctacgtggacg acacgcTgttcgtgaggttcgacagcgacgccAcgagtccgaggAaggagccgcgggcgccAtggatagagcaggagggg ccggagtattgggaccgggaGacacagatctCcaagaccaacacacagactTaccgagagagcctgcggaacctgcgcgg ctactacaaccagagcgaggccgggtctcacaccctccagagGatgtacggctgcgacgtggggccggacgggcgcctcc tccgcgggcatAaccagtacgcctacgacggcaaggattacatcgccctgaacgaggacctgcgctcctggaccgccgcg gacacggcggctcagatctcccagcgcaagtTggaggcggcccgtgTggcggagcagctgagagcctacctggagggcga gtgcgtggagtggctccgcagataccTggagaacgggaaggacaagctggagcgcgctgaccccccaaagacacacgtga cccaccacccatctctgaccatgaggccaccctgaggtgctgggccctgggtttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagttcaggtgga

B*400103

(SEQ ID NO: 1434)

gctcccactccatgaggtatttcCacaccgccatgtcccggcccggccgcggggagccccgcttcatcaccgtgggctac gtggacgacacgcTgttcgtgaggttcgacagcgacgccAcgagtccgaggAaggagccgcgggcgccgtggatagagca ggaggggccggagtattgggaccgggaGacacagatctCcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatAaccagtacgcctacgacggcaaggattacatcgccctgaacgaggacctgcgctcctggac cgccgcggacacggcggctcagatctcccagcgcaagtTggaggcggcccgtgTggcggagcagctgagagcctacctgg agggcgagtgcgtggagtggctccgcagataccTggagaacgggaaggacaagctggagcgcgctgaccccccaaagaca cacgtgacccaccacccatctctgaccatgaggccaccctgaggtgctgggccctgggtttctaccctgcggagatcac actgacctggcagcgggatggcgaggaccaaactcaggacactgagcttgtggagaccagaccagcaggagatagaacct tccagaagtgggcagctgtggtggtgccttctggagaagagcagagatacacatgccatgtacagcatgaggggctgccg aagcccctcaccctgagatggg

B*4002

(SEQ ID NO: 1435)

atgcgggtcacggcgccccgaaccctcctcctgctgctctgggggcagtggccctgaccgagacctgggcTggctccca ctccatgaggtatttccacacctccgtgtcccggcccggccgcggggagccccgcttcatcaccgtgggctacgtggacg acacgctgttcgtgaggttcgacagcgacgccacgagtccgaggaaggagccgcgggcgccatggatagagcaggagggg ccggagtattgggaccgggagacacagatctCcaagaccaacacacagactTaccgagagagcctgcggaacctgcgcgg ctactacaaccagagcgaggccgggtctcacaccctccagagcatgtacggctgcgacgtggggccggacgggcgcctcc tccgcgggcatAaccagtacgcctacgacggcaaggattacatcgccctgaacgaggacctgcgctcctggaccgccgcg gacacggcggctcagatcacccagcgcaagtgggaggcggcccgtgTggcggagcagcTgagagcctacctggagggcga gtgcgtggagtggctccgcagataccTggagaacgggaaggagacgctgcagcgcgcggaccccccaaagacacacgtga -continued

```
cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga
```

B*4003

(SEQ ID NO: 1436)
```
atgcgggtcacggcgcccgaaccctcctcctgctgctctgggggcagtggccctgaccgagacctgggcTggctccca ctccatgaggtatttccacacctccgtgtcccggcccggccgcggggagccccgcttcatcaccgtgggctacgtggacg acacgctgttcgtgaggttcgacagcgacgccacgagtccgaggaaggagccgcgggcgccatggatagagcaggagggg ccggagtattgggaccgggaGacacagatctCcaagaccaacacacagactTaccgagagagcctgcggaacctgcgcgg ctactacaaccagagcgaggccgggtctcacaccctccagagcatgtacggctgcgacgtggggccggacgggcgcctcc tccgcgggcatgaccagtCcgcctacgacggcaaggattacatcgccctgaacgaggacctgcgctcctggaccgccgcg gacacggcggctcagatcacccagcgcaagtgggaggcggcccgtgTggcggagcagcTgagagcctacctggagggcga gtgcgtggagtggctccgcagatacctggagaacgggaaggagacgctgcagcgcgcggaccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga
```

B*4004

(SEQ ID NO: 1437)
```
atgcgggtcacggcgcccgaaccctcctcctgctgctctgggggcagtggccctgaccgagacctgggcTggctccca ctccatgaggtatttccacacctccgtgtcccggcccggccgcggggagccccgcttcatcaccgtgggctacgtggacg acacgctgttcgtgaggttcgacagcgacgccacgagtccgaggaaggagccgcgggcgccatggatagagcaggagggg ccggagtattgggaccgggagacacagatctccaagaccaacacacagacttaccgagagagcctgcggaacctgcgcgg ctactacaaccagagcgaggccgggtctcacatcatccagaggatgtatggctgcgacCtggggccggacgggcgcctcc tccgcgggcatAaccagtacgcctacgacggcaaggattacatcgccctgaacgaggacctgcgctcctggaccgccgcg gacacggcggctcagatcacccagcgcaagtgggaggcggcccgtgTggcggagcagcTgagagcctacctggagggcga gtgcgtggagtggctccgcagatacctggagaacgggaaggagacgctgcagcgcgcggaccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga
```

B*4005

(SEQ ID NO: 1438)
```
atgcgggtcacggcgcccgaaccctcctcctgctgctctgggggcagtggccctgaccgagacctgggcTggctccca ctccatgaggtatttccacacctccgtgtcccggcccggccgcggggagccccgcttcatcaccgtgggctacgtggacg acacgctgttcgtgaggttcgacagcgacgccacgagtccgaggaaggagccgcgggcgccatggatagagcaggagggg ccggagtattgggaccgggagacacagatctccaagaccaacacacagacttaccgagagagcctgcggaacctgcgcgg ctactacaaccagagcgaggccgggtctcacaccctccagagcatgtacggctgcgacgtggggccggacgggcgcctcc tccgcgggcatAaccagtacgcctacgacggcaaggattacatcgccctgaacgaggacctgcgctcctggaccgccgcg gacacggcggctcagatcacccagcgcaagtgggaggcggcccgtgaggcggagcagcTgagagcctacctggagggccT
```

-continued

```
gtgcgtggagtggctccgcagatacctggagaacgggaaggagacgctgcagcgcgcggaccccccaaagacacacgtga
cccaccacccatctctgaccatgaggccaccctgaggtgctgggccctgggcttctaccctgcggagatcacactgacc
tggcagcgggatggcgaggaccaaactcaggacactgagcttgtggagaccagaccagcaggagatagaaccttccagaa
gtgggcagctgtggtggtgccttctggagaagagcagagatacacatgccatgtacagcatgaggggctgccgaagcccc
tcaccctgagatgggagccgtcttcccagtccaccgtccccatcgtgggcattgttgctggcctggctgtccta...gca
gttgtggtcatcggagctgtggtcgctgctgtgatgtgtaggaggaagagCtcaggtgga
```

B*400601 (SEQ ID NO: 1439)

```
atgcgggtcacggcgccccgaaccctcctcctgctgctctgggggcagtggccctgaccgagacctgggcTggctccca
ctccatgaggtatttccacacctccgtgtcccggcccggccgcggggagccccgcttcatcaccgtgggctacgtggacg
acacgctgttcgtgaggttcgacagcgacgccacgagtccgaggaaggagccgcgggcgccatggatagagcaggagggg
ccggagtattgggaccggggagacacagatctccaagaccaacacacagacttaccgagagagcctgcggaacctgcgcgg
ctactacaaccagagcgaggccgggtctcacacttggcagaCgatgtaTggctgcgacgtggggccggacgggcgcctcc
tccgcgggcatAaccagtacgcctacgacggcaaggattacatcgccctgaacgaggacctgcgctcctggaccgccgcg
gacacggcggctcagatcacccagcgcaagtgggaggcggcccgtgTggcggagcagcTgagagcctacctggagggcga
gtgcgtggagtggctccgcagatacctggagaacgggaaggagacgctgcagcgcgcggaccccccaaagacacacgtga
cccaccacccatctctgaccatgaggccaccctgaggtgctgggccctgggcttctaccctgcggagatcacactgacc
tggcagcgggatggcgaggaccaaactcaggacactgagcttgtggagaccagaccagcaggagatagaaccttccagaa
gtgggcagctgtggtggtgccttctggagaagagcagagatacacatgccatgtacagcatgaggggctgccgaagcccc
tcaccctgagatgggagccgtcttcccagtccaccgtccccatcgtgggcattgttgctggcctggctgtccta...gca
gttgtggtcatcggagctgtggtcgctgctgtgatgtgtaggaggaagagCtcaggtgga
```

B*4007 (SEQ ID NO: 1440)

```
atgcgggtcacggcgccccgaaccgtcctcctgctgctctcggcggccctggccctgaccgagacctgggccggctccca
ctccatgaggtatttccacaccgccatgtcccggcccggccgcggggagccccgcttcatcaccgtgggctacgtggacg
acacgctgttcgtgaggttcgacagcgacgccacgagtccgaggaaggagccgcgggcgccatggatagagcaggagggg
ccggagtattgggaccggggagacacagatctTcaagaccaacacacagactTaccgagagagcctgcggaacctgcgcgg
ctactacaaccagagcgaggccgggtctcacaccctccagagGatgtacggctgcgacgtggggccggacgggcgcctcc
tccgcgggcatAaccagtacgcctacgacggcaaggattacatcgccctgaacgaggacctgcgctcctggaccgccgcg
gacacggcggctcagatctcccagcgcaagtTggaggcggcccgtgTggcggagcagctgagagcctacctggagggcga
gtgcgtggagtggctccgcagatacctggagaacgggaaggacaagctggagcgcgctgaccccccaaagacacacgtga
cccaccacccatctctgaccatgaggccaccctgaggtgctgggccctgggtttctaccctgcggagatcacactgacc
tggcagcgggatggcgaggaccaaactcaggacactgagcttgtggagaccagaccagcaggagatagaaccttccagaa
gtgggcagctgtggtggtgccttctggagaagagcagagatacacatgccatgtacagcatgaggggctgccgaagcccc
tcaccctgagatgggagccgtcttcccagtccaccgtccccatcgtgggcattgttgctggcctggctgtccta...gca
gttgtggtcatcggagctgtggtcgctgctgtgatgtgtaggaggaagagttcaggtgga
```

B*4008 (SEQ ID NO: 1441)

```
atgcgggtcacggcgccccgaaccctcctcctgctgctctgggggcagtggccctgaccgagacctgggcTggctccca
ctccatgaggtatttccacacctccgtgtcccggcccggccgcggggagccccgcttcatcaccgtgggctacgtggacg
acacgctgttcgtgaggttcgacagcgacgccacgagtccgaggaaggagccgcgggcgccatggatagagcaggagggg
ccggagtattgggaccggaacacacagatctTcaagaccaacacacagactTaccgagagagcctgcggaacctgcgcgg
ctactacaaccagagcgaggccgggtctcacaccctccagagcatgtacggctgcgacgtggggccggacgggcgcctcc
```

-continued tccgcgggcatAaccagtacgcctacgacggcaaggattacatcgccctgaacgaggacctgcgctcctggaccgccgcg gacacggcggctcagatcacccagcgcaagtgggaggcggcccgtgTggcggagcagcTgagagcctacctggagggcga gtgcgtggagtggctccgcagatacctggagaacgggaaggagacgctgcagcgcgcggaccccccaaagacacacgtga cccaccaccccatctctgaccatgaggccaccctgaggtgctgggccctggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga B*4009 (SEQ ID NO: 1442)
gctcccactccatgaggtatttcCacacctccgtgtcccggcccggccgcggggagccccgcttcatcaccgtgggctac gtggacgacacgcTgttcgtgaggttcgacagcgacgccAcgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggccgggtctcacaccctccagagcatgtacggctgcgacgtggggccggacggg cgcctcctccgcgggTatgaccagtacgcctacgacggcaaggattacatcgccctgaacgaggacctgcgctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggaDacgctgCagcgcgcGg B*4010 (SEQ ID NO: 1443)
gctcccactccatgaggtatttctacaccgccatgtcccggcccggccgcggggagccccgcttcatcGcagtgggctac gtggacgacacgcagttcgtgaggttcgacagcgacgccAcgagtccgaggAaggagccgcgggcgccAtggatagagca ggaggggccggagtattgggaccgggaDacacagatctCcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatAaccagtacgcctacgacggcaaggattacatcgccctgaacgaggacctgcgctcctggac cgccgcggacacggcggctcagatctcccagcgcaagtTggaggcggcccgtgTggcggagcagctgagagcctacctgg agggcgagtgcgtggagtggctccgcagatacctggagaacgggaaggacaagctggagcgcgctg B*4011 (SEQ ID NO: 1444)
gctcccactccatgaggtatttcCacacctccgtgtcccggcccggccgcggggagccccgcttcatcaccgtgggctac gtggacgacacgcTgttcgtgaggttcgacagcgacgccAcgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggccgggtctcacaccctccagagGatgtacggctgcgacgtggggccggacggg cgcctcctccgcgggcatAaccagtacgcctacgacggcaaggattacatcgccctgaacgaggacctgcgctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggaDacgctgCagcgcgcGg B*4012 (SEQ ID NO: 1445)
atgcgggtcacggcgccccgaaccgtcctcctgctgctctcgggAgccctggccctgaccgagacctgggccggctccca ctccatgaggtatttctacaccgccatgtcccggcccggccgcggggagccccgcttcatctcagtgggctacgtggacg acacGcagttcgtgaggttcgacagcgacgccgcgagtccgagagaggagccgcgggcgccAtggatagagcaggagggg ccggagtattgggaccgggaDacacagatctCcaagaccaacacacagactTaccgagagagcctgcggaacctgcgcgg ctactacaaccagagcgaggccgggtctcacaccctccagagGatgtacggctgcgacgtggggccggacgggcgcctcc tccgcgggcatAaccagtacgcctacgacggcaaggattacatcgccctgaacgaggacctgcgctcctggaccgccgcg gacacgcggctcagatctcccagcgcaagtTggaggcggcccgtgTggcggagcagctgagagcctacctggagggcga gtgcgtggagtggctccgcagatacctggagaacgggaaggacaagctggagcgcgctg

B*4013

(SEQ ID NO: 1446)

atgcgggtcacggcgccccgaaccctcctcctgctgctctgggggcagtggccctgaccgagacctgggcTggctccca ctccatgaggtatttccacacctccgtgtcccggcccggccgcggggagccccgcttcatcaccgtgggctacgtggacg acacgctgttcgtgaggttcgacagcgacgccacgagtccgaggaaggagccgcgggcgccatggatagagcaggaggg ccggagtattgggaccgggagacacagatcttcaagaccaacacacagacttaccgagagaacctgcggatcgCgctcCg ctactacaaccagagcgaggccgggtctcacaccctccagagcatgtacggctgcgacgtggggccggacgggcgcctcc tccgcgggcatAaccagtacgcctacgacggcaaggattacatcgccctgaacgaggacctgcgctcctggaccgccgcg gacacgcggctcagatcacccagcgcaagtgggaggcggcccgtgTggcggagcagcTgagagcctacctggagggcga gtgcgtggagtggctccgcagatacctggagaacgggaaggagacgctgcagcgcgcgg

B*401401

(SEQ ID NO: 1447)

gctcccactccatgaggtatttcCacaccgccatgtcccggcccggccgcggggagccccgcttcatcaccgtgggctac gtggacgacacgcTgttcgtgaggttcgacagcgacgccAcgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggccgggtctcacaccctccagaggatgtacggctgcgacgtggggccggacggg cgcctcctccgcgggcatAaccagtacgcctacgacggcaaggattacatcgccctgaacgaggacctgcgctcctggac cgcggcggacacCgcggctcagatcacccagcgcaagtgggaggcggcccgtgTggcggagcagcTgagagcctacctgg agggcgagtgcgtggagtggctccgcagatacctggagaacgggaaggacaagctggagcgcgctg

B*401402

(SEQ ID NO: 1448)

gctcccactccatgaggtatttcCacaccgccatgtcccggcccggccgcggggagccccgcttcatcaccgtgggctac gtggacgacacgcTgttcgtgaggttcgacagcgacgccAcgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggccgggtctcacaccctccagaggatgtacggctgcgacgtggggccggacggg cgcctcctccgcgggcatAaccagtacgcctacgacggcaaggattacatcgccctgaacgaggacctgcgctcctggac cgcGgcggacacggcggctcagatcacccagcgcaagtgggaggcggcccgtgTggcggagcagcTgagagcctacctgg agggcgagtgcgtggagtggctccgcagatacctggagaacgggaaggacaagctggagcgcgctg

B*4015

(SEQ ID NO: 1449)

gctcccactccatgaggtatttccacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggccgggtctcacaccctccagagcatgtacggctgcgacgtggggccggacggg cgcctcctccgcgggcataaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggaTtggctccgcagatacctggagaacgggaaggacaagctggagcgcgctg

B*4016

(SEQ ID NO: 1450)

atgcgggtcacggcgccccgaaccgtcctcctgctgctctcggcggccctggccctgaccgagacctgggccggctccca ctccatgaggtatttcCacaccgccAtgtcccggcccggccgcggggagccccgcttcatcaccgtgggctacgtggacg acacgcTgttcgtgaggttcgacagcgacgccAcgagtccgaggaaggagccgcgggcgccAtggatagagcaggaggg ccggagtattgggaccgggaGacacagatctCcaagaccaacacacagactTaccgagagagcctgcggaacctgcgcgg ctactacaaccagagcgaggccgggtctcacaccctccagagcatgtacggctgcgacgtggggccggacgggcgcctcc tccgcgggcatAaccagtacgcctacgacggcaaggattacatcgccctgaacgaggacctgcgctcctggaccgccgcg -continued gacacggcggctcagatcacccagcgcaagtgggaggcggcccgtgaggcggagcagcggagagcctacctggagggcga gtgcgtggagtggctccgcagatacctggagaacgggaaggacaagctggagcgcgctg

B*4018

(SEQ ID NO: 1451)

gctcccactccatgaggtatttcCacacctccgtgtcccggcccggccgcggggagccccgcttcatcaccgtgggctac gtggacgacacgcTgttcgtgaggttcgacagcgacgccAcgagtccgaggaaggagccgcgggcgccatggatagagca ggaggggccggagtattgggaccgggagacacagatctCcaagaccaacacacagacttaccgagagagcctgcggaacc tgcgcggctactacaaccagagcgaggcccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggaGacgctgCagcgcgcGg

B*4019

(SEQ ID NO: 1452)

gctcccactccatgaggtatttccacacctccgtgtcccggcccggccgcggggagccccgcttcatcaccgtgggctac gtggacgacacgctgttcgtgaggttcgacagcgacgccAcgagtccgaggaaggagccgcgggcgccatggatagagca ggaggggccggagtattgggaccgggagacacagatctCcaagaccaacAcacagacttaccgagagaacctgcggaTcg cgctccgctactacaaccagagcgaggcccgggtctcacaccctccagagcatgtacggctgcgacgtggggccggacggg cgcctcctccgcgggcatAaccagtacgcctacgacggcaaggattacatcgccctgaacgaggacctgcgctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggagacgctgCagcgcgcgg

B*4020

(SEQ ID NO: 1453)

atgcgggtcacggcgccccgaaccctcctcctgctgctctgggggcagtggccctgaccgagacctgggcTggctccca ctccatgaggtatttccacacctccgtgtcccggcccggccgcggggagccccgcttcatcaccgtgggctacgtggacg acacgctgttcgtgaggttcgacagcgacgccacgagtccgaggaaggagccgcgggcgccatggatagcaggagggg ccggagtattgggaccgggaGacacagatctCcaagaccaacacacagactTaccgagagagcctgcggaacctgcgcgg ctactacaaccagagcgaggccgggtctcacaccctccagagGatgtacggctgcgacgtggggccggacgggcgcctcc tccgcgggcatgaccagtCcgcctacgacggcaaggattacatcgccctgaacgaggacctgcgctcctggaccgccgcg gacacggcggctcagatcacccagcgcaagtgggaggcggcccgtgTggcggagcagcTgagagcctacctggagggcga gtgcgtggagtggctccgcagatacctggagaacgggaaggagacgctgcagcgcgcgg

B*4021

(SEQ ID NO: 1454)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccCgggcgccAtggatagagca ggaggggccggagtattgggaccgggaGacacagatctCcaagaccaacacacagactTaccgagagagcctgcggaacc tgcgcggctactacaaccagagcgaggcccgggtctcacaccctccagagGatgtacggctgcgacgtggggccggacggg cgcctcctccgcgggcatAaccagtacgcctacgacggcaaggattacatcgccctgaacgaggacctgcgctcctggac cgccgcggacacggcggctcagatctcccagcgcaagtTggaggcggcccgtgTggcggagcagctgagagcctacctgg agggcgagtgcgtggagtggctccgcagatacctggagaacgggaaggacaagctggagcgcgctg

B*4023

(SEQ ID NO: 1455)

atgcgggtcacggcaccccgaaccgtcctcctgctgctctcggcggccctggccctgaccgagacctgggccggctccca ctccatgaggtatttcCacaccgccatgtcccggcccggccgcggggagccccgcttcatcaccgtgggctacgtggacg acacgcTgttcgtgaggttcgacagcgacgccAcgagtccgaggAaggagccgcgggcgccAtggatagcaggagggg ccggagtattgggaccgggaGacacagatctCcaagaccaacacacagactTaccgagagagcctgcggaacctgcgcgg ctactacaaccagagcgaggcccgggtctcacaccctccagagGatgtacggctgcgacgtggggccggacgggcgcctcc -continued tccgcgggcatAaccagtacgcctacgacggcaaggattacatcgccctgaacgaggacctgcgctcctggaccgccgcg gacacggcggctcagatcTcccagcgcaagtgggaggcggcccgtgaggcggagcagcggagagcctacctggagggcga gtgcgtggagtggctccgcagatacctggagaacgggaaggacaagctggagcgcgctg

B*4024

(SEQ ID NO: 1456)

gctcccactccatgaggtatttcCacacctccgtgtcccggcccggccgcggggagccccgcttcatcaccgtgggctac gtggacgacacgctgttcgtgaggttcgacagcgacgccAcgagtccgaggaaggagccgcgggcgccAtggatagagca ggaggggccggagtattgggaccgggaDacacagatctCcaagaccaacAcacagactTaccgagagagcctgcggaacc tgcgcggctactacaaccagagcgaggcccgggtctcacaccctccagagcatgtacggctgcgacCtggggccCgacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggagacgctgCagcgcgcGg

B*4025

(SEQ ID NO: 1457)

gctcccactccatgaggtatttcCacaccgccatgtcccggcccggccgcggggagccccgcttcatcaccgtgggctac gtggacgacacgcTgttcgtgaggttcgacagcgacgccAcgagtccgaggAaggagccgcgggcgccAtggatagagca ggaggggccggagtattgggaccggaacacacagatctCcaagaccaacacacagactTaccgagagagcctgcggaacc tgcgcggctactacaaccagagcgaggcccgggtctcacaccctccagagGatgtacggctgcgacgtggggccggacggg cgcctcctccgcgggcatAaccagtacgcctacgacggcaaggattacatcgccctgaacgaggacctgcgctcctggac cgccgcggacacggcggctcagatctcccagcgcaagtGgaggcggcccgtgTggcggagcagctgagagcctacctgg agggcgagtgcgtggagtggctccgcagatacctggagaacgggaaggacaagctggagcgcgctg

B*4026

(SEQ ID NO: 1458)

gctcccactccatgaggtatttccacacctccgtgtcccggcccggccgcggggagccccgcttcatcaccgtgggctac gtggacgacacgctgttcgtgaggttcgacagcgacgccAcgagtccgaggaaggagccgcgggcgccatggatagagca ggaggggccggagtattgggaccgggaDacacagatctCcaagaccaacacacagactTaccgagagagcctgcggaacc tgcgcggctactacaaccagagcgaggcccgggtctcacaccctccagaggatgtacggctgcgacgtggggccggacggg cgcctcctccgcgggcataaccagtacgcctacgacggcaaAgattacatcgccctgaacgaggacctgagctcctggac cgccgcggacacggcggctcagatcacccagcgcaagtgggaggcggcccgtgaggcggagcagcTgagagcctacctgg agggccTgtgcgtggagtggctccgcagatacctggagaacgggaaggagacgctgcagcgcgcgg

B*4027

(SEQ ID NO: 1459)

gctcccactccatgaggtatttccacacctccgtgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggcccgggtctcacaccctccagagcatgtacggctgcgacgtggggccggacggg cgcctcctccgcgggcataaccagAacgcctacgacggcaaggattacatcgccctgaacgaggacctgcgctcctggac cgccgcggacacggcggctcagatcacccagcgcaagtgggaggcggcccgtgtggcggagcagctgagagcctacctgg agggcgagtgcgtggagtggctccgcagatacctggagaacgggaaggagacgctgcagcgcgcgg

B*4028

(SEQ ID NO: 1460)

gctcccactccatgaggtatttccacacctccgtgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggcccgggtctcacatcatccagaggatgtatggctgcgacCtggggccggacggg cgcctcctccgcgggcataaccagtacgcctacgacggcaaAgattacatcgccctgaacgaggacctgagctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*4029

(SEQ ID NO: 1461)
gctcccactccatgaggtatttccacacctccgtgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccCggagacacagatctccaagaccaacacacagacttaccgagagagcctgcggaacc tgcgcggctactacaaccagagcgaggccgggtctcacaccctccagagcatgtacggctgcgacgtggggccggacggg cgcctcctccgcgggcatAaccagtacgcctacgacggcaaggattacatcgccctgaacgaggacctgcgctcctggac cgccgcggacacggcggctcagatcacccagcgcaagtgggaggcggcccgtgtggcggagcagctgagagcctacctgg agggcgagtgcgtggagtggctccgcagatacctggagaacgggaaggagacgctgcagcgcgcgg

B*4030

(SEQ ID NO: 1462)
gctcccactccatgaggtatttccacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggacgggagacacagatctccaagaccaacacacagacttaccgagagagcctgcggaacc tgcgcggctactacaaccagagcgaggccgggtctcacatcatccagGtgatgtatggctgcgacgtggggccggacggg cgcctcctccgcgggcataaccagtacgcctacgacggcaaggattacatcgccctgaacgaggacctgcgctcctggac cgccgcggacacggcggctcagatctcccagcgcaagtTggaggcggcccgtgtggcggagcagcTgagagcctacctgg agggcgagtgcgtggagtggctccgcagatacctggagaacgggaaggacaagctggagcgcgctg

B*4031

(SEQ ID NO: 1463)
gctcccactccatgaggtatttcCacaccgccatgtcccggcccggccgcggggagccccgcttcatcaccgtgggctac gtggacgacacgcTgttcgtgaggttcgacagcgacgccAcgagtccgaggAaggagccgcgggcgccAtggatagagca ggaggggccggagtattgggacgggaGacacagatctCcaagaccaacacacagactTaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatctcccagcgcaagtTggaggcggcccgtgTggcggagcagctgagagcctacctgg agggcgagtgcgtggagtggctccgcagatacctggagaacgggaaggacaagctggagcgcgctg

B*4032

(SEQ ID NO: 1464)
gctcccactccatgaggtatttcCacaccgccAtgtcccggcccggccgcggggagccccgcttcatcaccgtgggctac gtggacgacacgcTgttcgtgaggttcgacagcgacgccAcgagtccgaggaaggagccgcgggcgccAtggatagagca ggaggggccggagtattgggacgggaGacacagatctCcaagaccaacacacagactTaccgagagagcctgcggaacc tgcgcggctactacaaccagagcgaggccgggtctcacaccctccagagcatgtacggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgaggcggagcagcggagagcctacctgg agggcgagtgcgtggagtggctccgcagatacctggagaacgggaaggacaagctggagcgcgctg

B*4033

(SEQ ID NO: 1465)
gctcccactccatgaggtatttcCacaccgccatgtcccggcccggccgcggggagccccgcttcatcaccgtgggctac gtggacgacacgcTgttcgtgaggttcgacagcgacgccAcgagtccgaggAaggagccgcgggcgccAtggatagagca ggaggggccggagtattgggacgggaGacacagatctCcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatgaccagtacgcctacgacggcaaggattacatcgccctgaacgaggacctgcgctcctggac -continued cgccgcggacacggcggctcagatctcccagcgcaagtTggaggcggcccgtgTggcggagcagctgagagcctacctgg agggcgagtgcgtggagtggctccgcagatacctggagaacgggaaggacaagctggagcgcgctg B*4034
(SEQ ID NO: 1466)
gctcccactccatgaggtatttccacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggcccgggtctcacatcatccaggtgatgtatggctgcgacgtggggccggacggg cgcctcctccgcgggcataaccagtacgcctacgacggcaagAattacatcgccctgaacgaggacctgcgctcctggac cgccgcggacacggcggctcagatctcccagcgcaagttggaggcggcccgtgtggcggagcagctgagagcctacctgg agggcgagtgcgtggagtggctccgcagatacctggagaacgggaaggacaagctggagcgcgctg B*4035
(SEQ ID NO: 1467)
gctcccactccatgaggtatttcCacacctccgtgtcccggcccggccgcggggagccccgcttcatcaccgtgggctac gtggacgacacgcTgttcgtgaggttcgacagcgacgccAcgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggcccgggtctcacaccctccagagcatgtacggctgcgacgtggggccggacggg cgcctcctccgcgggcatAaccagtacgcctacgacggcaaggattacatcgccctgaacgaggacctgAgctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggaDacgctgCagcgcgcGg B*4036
(SEQ ID NO: 1468)
gctcccactccatgaggtatttccacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggcccgggtctcacaccctccagagGatgtacggctgcgacgtggggccggacggg cgcctcctccgcgggcataaccagtTcgcctacgacggcaaggattacatcgccctgaacgaggacctgcgctcctggac cgccgcggacacggcggctcagatctcccagcgcaagtTggaggcggcccgtgTggcggagcagctgagagcctacctgg agggcgagtgcgtggagtggctccgcagatacctggagaacgggaaggacaagctggagcgcgctg B*4037
(SEQ ID NO: 1469)
gctcccactccatgaggtatttcCacacctccgtgtcccggcccggccgcggggagccccgcttcatcaccgtgggctac gtggacgacacgcTgttcgtgaggttcgacagcgacgccAcgagtccgaggaaggagccgcgggcgccatggatagagca ggaggggccggagtattgggaccgggagacacagatctCcaagaccaacacacagacttaccgagagaAcctgcggaacc tgcgcggctactacaaccagagcgaggcccgggtctcacaccctccagagcatgtacggctgcgacgtggggccggacggg cgcctcctccgcgggcatAaccagtacgcctacgacggcaaggattacatcgccctgaacgaggacctgcgctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggaDacgctgCagcgcgcGg B*4038
(SEQ ID NO: 1470)
gctcccactccatgaggtatttccacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggcccgggtctcacaccctccagaggatgtacggctgcgacgtggggccggacggg cgcctcctccgcgggcataaccagtCcgcctacgacggcaaggattacatcgccctgaacgaggacctgcgctcctggac -continued cgccgcggacacggcggctcagatctcccagcgcaagtTggaggcggcccgtgTggcggagcagctgagagcctacctgg agggcgagtgcgtggagtggctccgcagatacctggagaacgggaaggacaagctggagcgcgctg

B*4039

(SEQ ID NO: 1471)

ggggcagtggccctgaccgagacctgggcTggctcccactccatgaggtatttccacacctccgtgtcccggcccggcc gcggggagccccgcttcatcaccgtgggctacgtggacgacacgctgttcgtgaggttcgacagcgacgccacgagtccg aggaaggagccgcgggcgccatggatagagcaggaggggccggagtattgggaccgggagacacagatctccaagaccaa cacacagacttaccgagagagcctgcggaacctgcgcggctactacaaccagagcgaggccgggtctcacaccctccaga gcatgtacggctgcgacgtggggccggacgggcgcctcctccgcgggcatAaccagtacgcctacgacggcaaggattac atcgccctgaacgaggacctgcgctcctggaccgccgcggacacggcggctcagatcacccagcgcaagtgggaggcggc ccgtgtggcggagcagcTgagagcctacctggagggcaCgtgcgtggagtggctccgcagatacctggagaacgggaagg agacgctgcagcgcgcggacccccaaagacacacgtgacccaccacccatctctgaccatgaggccaccctgaggtgc tgggccctgggCttctaccctgcggagatcacactgacctggcagcgggatggcgaggaccaaactcaggacactgagct tgtggagaccagaccagcaggagatagaaccttccagaagtgggcagctgtggtggtgccttctggagaagagcagagat acacatgccatgtacagcatgaggggctgccgaagcccctcaccctgagatgggagccgtcttcccagtccaccgtcccc atcgtgggcattgttgctggcctggctgtcct

B*4040

(SEQ ID NO: 1472)

gctcccactccatgaggtatttctacacctccgtgtcccggcccggccgcggggagccccgcttcatcaccgtgggctac gtggacgacacgcTgttcgtgaggttcgacagcgacgccAcgagtccgaggaaggagccgcgggcgccatggatagagca ggaggggccggagtattgggaccgggagacacagatctCcaagaccaacacacagacttaccgagagagcctgcggaacc tgcgcggctactacaaccagagcgaggccgggtctcacaccctccagagcatgtacggctgcgacgtggggccggacggg cgcctcctccgcgggcatAaccagtacgcctacgacggcaaggattacatcgccctgaacgaggacctgcgctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggaDacgctgCagcgcgcGg

B*4042

(SEQ ID NO: 1473)

gctcccactccatgaggtatttccacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggccgggtctcacaccctccagaggatgtacggctgcgacgtggggccggacggg cgcctcctccgcgggTatgaccagtacgcctacgacggcaaggattacatcgccctgaacgaggacctgcgctcctggac cgccgcggacacggcggctcagatctcccagcgcaagtTggaggcggcccgtgTggcggagcagctgagagcctacctgg agggcgagtgcgtggagtggctccgcagatacctggagaacgggaaggacaagctggagcgcgctg

B*4043

(SEQ ID NO: 1474)

gctcccactccatgaggtatttcCacaccgccatgtcccggcccggccgcggggagccccgcttcatcaccgtgggctac gtggacgacacgcTgttcgtgaggttcgacagcgacgccAcgagtccgaggAaggagccgcgggcgccAtggatagagca ggaggggccggagtattgggaccgggaGacacagatctCcaagaccaacacacagactgaccgagagagcctgcggaacc tgcgcggctactacaaccagagcgaggccgggtctcacaccctccagagGatgtacggctgcgacgtggggccggacggg cgcctcctccgcgggcatAaccagtacgcctacgacggcaaggattacatcgccctgaacgaggacctgcgctcctggac cgccgcggacacggcggctcagatctcccagcgcaagtTggaggcggcccgtgTggcggagcagctgagagcctacctgg agggcgagtgcgtggagtggctccgcagatacctggagaacgggaaggacaagctggagcgcgctg

B*4044

(SEQ ID NO: 1475)

gctcccactccatgaggtatttccacacctccgtgtcccggcccggccgcggggagccccgcttcatcaccgtgggctac gtggacgacacgcTgttcgtgaggttcgacagcgacgccAcgagtccgaggaaggagccgcgggcgccatggatagagca ggaggggccggagtattgggaccgggagacacagatctCcaagaccaacacacagactTaccgagagagcctgcggaacc tgcgcggctactacaaccagagcgaggccgggtctcacacttggcagaCgatgtaTggctgcgacgtggggccggacggg cgcctcctccgcgggcatgaccagtacgcctacgacggcaaggattacatcgccctgaacgaggacctgcgctcctggac cgccgcggacacggcggctcagatcacccagcgcaagtgggaggcggcccgtgTggcggagcagcTgagagcctacctgg agggcgagtgcgtggagtggctccgcagatacctggagaacgggaaggagacgctgCagcgcgcgg

B*4101

(SEQ ID NO: 1476)

atgcgggtcacggcaccccgaaccgtcctcctgctgctctcggcggccctggccctgaccgagacctgggccggctccca ctccatgaggtatttccacaccgccatgtcccggcccggccgcggggagccccgcttcatcaccgtgggctacgtggacg acacgctgttcgtgaggttcgacagcgacgccacgagtccgaggaaggagccgcgggcgccatggatagagcaggagggg ccggagtattgggaccgggagacacagatctccaagaccaacacacagacttaccgagagagcctgcggaacctgcgcgg ctactacaaccagagcgaggccgggtctcacacttgGcagaggatgtaTggctgcgacgtggggccggacgggcgcctcc tccgcgggcataaccagtacgcctacgacggcaaggattacatcgccctgaacgaggacctgcgctcctggaccgcggcg gacaccgcggctcagatcacccagcgcaagtgggaggcggcccgtgtggcggagcaggaCagagcctacctggagggcaC gtgcgtggagtggctccgcagatacctggagaacgggaaggacacgctggagcgcgcggaccccccaaagacacacgtga cccaccaccccatctctgaccatgaggccacccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*4102

(SEQ ID NO: 1477)

atgcgggtcacggcaccccgaaccgtcctcctgctgctctcggcggccctggccctgaccgagacctgggccggctccca ctccatgaggtatttccacaccgccatgtcccggcccggccgcggggagccccgcttcatcaccgtgggctacgtggacg acacgctgttcgtgaggttcgacagcgacgccacgagtccgaggaaggagccgcgggcgccAtggatagagcaggagggg ccggagtattgggaccgggagacacagatctccaagaccaacacacagactTaccgagagagcctgcggaacctgcgcgg ctactacaaccagagcgaggccgggtctcacaccctccagagcatgtacggctgcgacgtggggccggacgggcgcctcc tccgcgggcataaccagtacgcctacgacggcaaggattacatcgccctgaacgaggacctgcgctcctggaccgcggcg gacaccgcggctcagatcacccagcgcaagtgggaggcggcccgtgtggcggagcaggaCagagcctacctggagggcaC gtgcgtggagtggctccgcagatacctggagaacgggaaggacacgctggagcgcgcggaccccccaaagacacacgtga cccaccaccccatctctgaccatgaggccacccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*4103

(SEQ ID NO: 1478)

gctcccactccatgaggtatttccacaccgccatgtcccggcccggccgcggAgagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagagcctgcggaacc -continued tgcgcggctactacaaccagagcgaggcccgggtctcacaccctccagaggatgtacggctgcgacgtggggccggacggg
cgcctcctccgcgggcataaccagtacgcctacgacggcaaggattacatcgccctgaacgaggacctgcgctcctggac
cgcggcggacaccgcggctcagatcacccagcgcaagtgggaggcggcccgtgtggcggagcaggaCagagcctacctgg
agggcacgtgcgtggagtggctccgcagatacctggagaacgggaaggacacgctggagcgcgcgg B*4104 (SEQ ID NO: 1479)
gctcccactccatgaggtatttccacaccgccatgtcccggcccggccgcggggagccccgcttcatcaccgtgggctac
gtggacgacacgctgttcgtgaggttcgacagcgacgccacgagtccgaggaaggagccgcgggcgccatggatagagca
ggaggggccggagtattgggaccgggagacacagatctccaagaccaacacacagacttaccgagagagcctgcggaacc
tgcgcggctactacaaccagagcgaggcccgggtctcacaccctccagagcatgtacggctgcgacctggggccCgacggg
cgcctcctccgcgggcatgaccagtacgcctacgacggcaaggattacatcgccctgaacgaggacctgcgctcctggac
cgcggcggacaccgcggctcagatcacccagcgcaagtgggaggcggcccgtgTggcggagcaggaCagagcctacctgg
agggcACgtgcgtggagtggctccgcagatacctggagaacgggaaggacacgctggagcgcgcGg B*4105 (SEQ ID NO: 1480)
gctcccactccatgaggtatttccacaccgccatgtcccggcccggccgcggggagccccgcttcatcaccgtgggctac
gtggacgacacgctgttcgtgaggttcgacagcgacgccacgagtccgaggaaggagccgcgggcgccatggatagagca
ggaggggccggagtattgggaccgggagacacagatctccaagaccaacacacagacttaccgagagagcctgcggaaGc
tgcgcggctactacaaccagagcgaggcccgggtctcacacttggcagaggatgtatggctgcgacgtggggccggacggg
cgcctcctccgcgggcataaccagtacgcctacgacggcaaggattacatcgccctgaacgaggacctgcgctcctggac
cgcggcggacaccgcggctcagatcacccagcgcaagtgggaggcggcccgtgtggcggagcaggacagagcctacctgg
agggcacgtgcgtggagtggctccgcagatacctggagaacgggaaggacacgctggagcgcgcgg B*4106 (SEQ ID NO: 1481)
gctcccactccatgaggtatttccacaccgccatgtcccggcccggccgcggggagccccgcttcatcaccgtgggctac
gtggacgacacgctgttcgtgaggttcgacagcgacgccacgagtccgaggaaggagccgcgggcgccatggatagagca
ggaggggccggagtattgggaccgggagacacagatctccaagaccaacacacagacttaccgagagagcctgcggaacc
tgcgcggctactacaaccagagcgaggcccgggtctcacacttgGcagaggatgtatggctgcgacgtggggccggacggg
cgcctcctccgcgggcataaccagtacgcctacgacggcaaggattacatcgccctgaacgaggacctgcgctcctggac
cgcggcggacaccgcggctcagatcacccagcgcaagtgggaggcggcccgtgtggcggagcaggaCagagcctacctgg
agggcaCgtgcgtggagtggctccgcagatacctggagaacgggaaggacacgctgCagcgcgcGg B*4201 (SEQ ID NO: 1482)
atgctggtcatggcgccccgaaccgtcctcctgctgctctcggcggccctggccctgaccgagacctgggccggctccca
ctccatgaggtatttctacacctccgtgtcccggcccggccgcggggagccccgcttcatctcagtgggctacgtggacg
acacccagttcgtgaggttcgacagcgacgccgcgagtccgagagaggagccgcgggcgccgtggatagagcaggagggg
ccggagtattgggaccggaacacacagatctacaaggcccaggcacagactgaccgagagagcctgcggaacctgcgcgg
ctactacaaccagagcgaggcccgggtctcacaccctccagagcatgtacggctgcgacgtggggccggacgggcgcctcc
tccgcgggcataaccagtacgcctacgacggcaaggattacatcgccctgaacgaggacctgcgctcctggaccgcggcg
gacaccgcggctcagatcacccagcgcaagtgggaggcggcccgtgtggcggagcaggaCagagcctacctggagggcaC
gtgcgtggagtggctccgcagatacctggagaacgggaaggacacgctggagcgcgcggaccccccaaagacacacgtga
cccaccaccccatctctgaccatgaggccaccctgaggtgctgggccctgggcttctaccctgcggagatcacactgacc
tggcagcgggatggcgaggaccaaactcaggacactgagcttgtggagaccagaccagcaggagatagaaccttccagaa
gtgggcagctgtggtggtgccttctggagaagagcagagatacacatgccatgtacagcatgaggggctgccgaagcccc -continued tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*4202

(SEQ ID NO: 1483)
ggctcccactccatgaggtatttcCacacctccgtgtcccggcccggccgcggggagccccgcttcatctcagtgggcta cgtggacgacacccagttcgtgaggttcgacagcgacgccgcgagtccgagagaggagccgcgggcgccgtggatagagc aggaggggccggagtattgggaccggaacacacagatctacaaggcccaggcacagactgaccgagagagcctgcggaac ctgcgcggctactacaaccagagcgaggccgggtctcacacctccagagcatgtacggctgcgacgtggggccggacgg gcgcctcctccgcgggcatAaccagtacgcctacgacggcaaggattacatcgccctgaacgaggacctgcgctcctgga ccgcggcggacaccgcggctcagatcacccagcgcaagtgggaggcggcccgtgTggcggagcaggaCagagcctacctg gagggcACgtgcgtggagtggctccgcagatacctggagaacgggaaggacacgctggagcgcgcGg

B*4204

(SEQ ID NO: 1484)
gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacacttggcagaCgatgtaTggctgcgacgtggggccggacggg cgcctcctccgcgggcatAaccagtacgcctacgacggcaaggattacatcgccctgaacgaggacctgcgctcctggac cgcggcggacaccgcggctcagatcacccagcgcaagtgggaggcggcccgtgTggcggagcaggaCagagcctacctgg agggcACgtgcgtggagtggctccgcagatacctggagaacgggaaggacacgctggagcgcgcGg

B*440201

(SEQ ID NO: 1485)
atgcgggtcacggcgccccgaaccctcctcctgctgctctgggggggcagtggccctgaccgagacctgggccggctccca ctccatgaggtatttctacaccgccatgtcccggcccggccgcggggagccccgcttcatcaccgtgggctacgtggacg acacgctgttcgtgaggttcgacagcgacgccAcgagtccgaggaaggagccgcgggcgccatggatagagcaggaggg ccggagtattgggaccgggagacacagatctccaagaccaacacacagacttaccgagagaacctgcgcaccgcgctcCg ctactacaaccagagcgaggccgggtctcacatcatccagaggatgtacggctgcgacgtggggccggacgggcgcctcc tccgcgggtatgaccaggacgcctacgacggcaaggattacatcgccctgaacgaggacctgagctcctggaccgcggcg gacaccgcggctcagatcacccagcgcaagtgggaggcggcccgtgtggcggagcaggaCagagcctacctggagggccT gtgcgtggagtcgctccgcagatacctggagaacgggaaggagacgctgcagcgcgcggaccccccaaagacacatgtga cccaccaccccatctctgaccatgaggTcaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga ctgctgtgatgtgtaggaggaagagCtcaggtgga

B*440202

(SEQ ID NO: 1486)
gctcccactccatgaggtatttctacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctcGaagaccaacacacagacttaccgagagaacctgcgcaccg cgctcCgctactacaaccagagcgaggccgggtctcacatcatccagaggatgtacggctgcgacgtggggccggacggg cgcctcctccgcgggtatgaccaggacgcctacgacggcaaggattacatcgccctgaacgaggacctgagctcctggac cgcggcggacaccgcggctcagatcacccagcgcaagtgggaggcggcccgtgtggcggagcaggaCagagcctacctgg -continued agggccTgtgcgtggagtcgctccgcagatacctggagaacgggaaggagacgctgcagcgcgcggacccccaaagaca catgtgacccaccaccccatctctgaccatgaggTcaccctgaggtgctgggccctgggcttctaccctgcggagatcac actgacctggcagcgggatggcgaggaccaaactcaggacaccgagcttgtggagaccagaccagcaggagatagaacct tccagaagtgggcagctgtggtggtgccttctggagaagagcagagatacacatgccatgtacagcatgagggctgccg aagcccctcaccctgagatggg

B*440203 (SEQ ID NO: 1487)

gctcccactccatgaggtatttctacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagaacctgcgcaccg cgctccgctactacaaccagagcgaggccgggtctcacatcatccagaggatgtacggctgcgacgtggggccggacggg cgcctcctccgcgggtatgaccaggacgcctacgacggcaaggattacatcgccctgaacgaggacctgagctcctggac cgcggcggacaccgcggctcagatcacccagcgcaagtgggaggcggcccgtgtCgcggagcaggacagagcctacctgg agggcctgtgcgtggagtcgctccgcagatacctggagaacgggaaggagacgctgcagcgcgcgg

B*440301 (SEQ ID NO: 1488)

atgcgggtcacggcgccccgaaccctcctcctgctgctctgggggcagtggccctgaccgagacctgggccggctccca ctccatgaggtatttctacaccgccatgtcccggcccggccgcggggagccccgcttcatcaccgtgggctacgtggacg acacgctgttcgtgaggttcgacagcgacgccAcgagtccgaggaaggagccgcgggcgccatggatagagcaggagggg ccggagtattgggaccgggagacacagatctccaagaccaacacacagacttaccgagagaacctgcgcaccgcgctccg ctactacaaccagagcgaggccgggtctcacatcatccagaggatgtacggctgcgacgtggggccggacgggcgcctcc tccgcgggtatgaccaggacgcctacgacggcaaggattacatcgccctgaacgaggacctgagctcctggaccgcggcg gacaccgcggctcagatcacccagcgcaagtgggaggcggcccgtgtggcggagcagcTgagagcctacctggagggccT gtgcgtggagtcgctccgcagatacctggagaacgggaaggagacgctgcagcgcgcggacccccaaagacacatgtga cccaccaccccatctctgaccatgaggTcaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgagggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*440302 (SEQ ID NO: 1489)

atgcgggtcacggcgccccgaaccctcctcctgctgctctgggggcagtggccctgaccgagacctgggccggctccca ctccatgaggtatttctacaccgccatgtcccggcccggccgcggggagccccgcttcatcaccgtgggctacgtggacg acacgctgttcgtgaggttcgacagcgacgccAcgagtccgaggaaggagccgcgggcgccatggatagagcaggagggg ccggagtattgggaccgggagacacagatctccaagaccaacacacagacttaccgagagaacctgcgcaccgcgctccg ctactacaaccagagcgaggccgggtctcacatcatccagaggatgtaTggctgcgacgtggggccggacgggcgcctcc tccgcgggtatgaccaggacgcctacgacggcaaggattacatcgccctgaacgaggacctgagctcctggaccgcggcg gacaccgcggctcagatcacccagcgcaagtgggaggcggcccgtgtggcggagcagcTgagagcctacctggagggccT gtgcgtggagtcgctccgcagatacctggagaacgggaaggagacgctgcagcgcgcggacccccaaagacacatgtga cccaccaccccatctctgaccatgaggTcaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgagggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*4404

(SEQ ID NO: 1490)

atgcgggtcacggcgcccgaaccctcctcctgctgctctgggggcagtggccctgaccgagacctgggccggctccca ctccatgaggtatttctacaccgccatgtcccggcccggccgcggggagccccgcttcatcaccgtgggctacgtggacg acacgctgttcgtgagGttcgacagcgacgccacgagtccgaggaaggagccgcgggcgccatggatagagcaggaggg ccggagtattgggaccgggagacacagatctccaagaccaacacacagacttaccgagagaacctgcgcaccgcgctccg ctactacaaccagagcgaggccgggtctcacatcatccagaggatgtacggctgcgacgtggggccggacgggcgcctcc tccgcgggtatgaccaggacgcctacgacggcaaggattacatcgccctgaacgaggacctgagctcctggaccgcggcg gacaccgcggctcagatcacccagcgcaagtgggaggcggcccgtgtggcggagcagcggagagcctacctggagggcaC gtgcgtggagtcgctccgcagatacctggagaacgggaaggagacgctgcagcgcgcggaccccccaaagacacatgtga cccaccacccatctctgaccatgaggTcaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*4405

(SEQ ID NO: 1491)

ggcgccatggatagagcaggaggggccggagtattgggaccgggaGacacagatctccaagaccaacacacagacttacc gagagaacctgcgcaCcGcgctcCgctactacaaccagagcgaggccgggtctcacatcAtccagaggatgtacggctgc gacgtggggccggacgggcgcctcctccgcgggTatgaccagtacgcctacgacggcaaggattacatcgccctgaacga ggacctgagctcctggaccgcggcggacaccgcggctcagatcacccagcgcaagtgggaggcggcccgtgtggcggagc aggaCagagcctacctggagggccTgtgcgtggagtCgctccgcagatacctggagaacgggaaggagacgctgcagcgc gcGg

B*4406

(SEQ ID NO: 1492)

atgcgggtcacggcgcccgaaccctcctcctgctgctctgggggcagtggccctgaccgagacctgggccggctccca ctccatgaggtatttctacaccgccatgtcccggcccggccgcggggagccccgcttcatTgcagtgggctacgtggacg acacccagttcgtgaggttcgacagcgacgccgcgagtccgaggacggagccccgggcgccatggatagagcaggagggg ccggagtattgggaccggaacacacagatcttcaagaccaacacacagacttaccgagagaacctgcggatcgcgctccg ctactacaaccagagcgaggccgggtctcacatcatccagaggatgtacggctgcgacgtggggccggacgggcgcctcc tccgcgggtatgaccaggacgcctacgacggcaaggattacatcgccctgaacgaggacctgagctcctggaccgcggcg gacaccgcggctcagatcacccagcgcaagtgggaggcggcccgtgtggcggagcaggaCagagcctacctggagggcct gtgcgtggagtCgctccgcagatacctggagaacgggaaggagacgctgcagcgcgcgg

B*4407

(SEQ ID NO: 1493)

atgcgggtcacggcgcccgaaccctcctcctgctgctctgggggcagtggccctgaccgagacctgggccggctccca ctccatgaggtatttctacaccgccatgtcccggcccggccgcggggagccccgcttcatcaccgtgggctacgtggacg acacgctgttcgtgaggttcgacagcgacgccgcgagtccgaggaaggagccgcgggcgccatggatagagcaggagggg ccggagtattgggaccgggagacacagatctccaagaccaacacacagacttaccgagagaacctgcgcaccgcgctccg ctactacaaccagagcgaggccgggtctcacatcatccagaggatgtaTggctgcgacgtggggccggacgggcgcctcc tccgcgggtatgaccaggacgcctacgacggcaaggattacatcgccctgaacgaggacctgagctcctggaccgcggcg gacaccgcggctcagatcacccagcgcaagtgggaggcggcccgtgtggcggagcagcTgagagcctacctggagggccT gtgcgtggagtcgctccgcagatacctggagaacgggaaggagacgctgcagcgcgcggaccccccaaagacacatgtga cccaccacccatctctgaccatgaggTcaccctgaggtgctgggccctgggcttctaccctgcggagatcacactgacc -continued tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*4408

(SEQ ID NO: 1494)

atgcgggtcacggcgccccgaaccctcctcctgctgctctgggggcagtggccctgaccgagacctgggccggctccca ctccatgaggtatttctacaccgccatgtcccggcccggccgcggggagcccgcttcatcaccgtgggctacgtggacg acacgctgttcgtgaggttcgacagcgacgccgcgagtccgaggatggcgccCgggcgccatggatagagcaggagggg ccggagtattgggaccgggagacacagatctccaagaccaacacacagacttaccgagagaacctgcgcaccgcgctcCg ctactacaaccagagcgaggccgggtctcacatcatccagaggatgtacggctgcgacgtggggccggacgggcgcctcc tccgcgggtatgaccaggacgcctacgacggcaaggattacatcgccctgaacgaggacctgagctcctggaccgcggcg gacaccgcggctcagatcacccagcgcaagtgggaggcggcccgtgtggcggagcaggaCagagcctacctggagggccT gtgcgtggagtcgctccgcagatacctggagaacgggaaggagacgctgcagcgcgcggaccccccaaagacacatgtga cccaccacccatctctgaccatgaggTcaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*4409

(SEQ ID NO: 1495)

atgcgggtcacggcgccccgaaccctcctcctgctgctctgggggcagtggccctgaccgagacctgggccggctccca ctccatgaggtatttctacaccgccatgtcccggcccggccgcggggagcccgcttcatcaccgtgggctacgtggacg acacgctgttcgtgaggttcgacagcgacgccAcgagtccgaggaaggagccgcgggcgccatggatagagcaggagggg ccggagtattgggaccgggagacacagatctccaagaccaacacacagacttaccgagagagcctgcggaacctgcgcgg ctactacaaccagagcgaggccgggtctcacatcatccagaggatgtacggctgcgacgtggggccggacgggcgcctcc tccgcgggtatgaccaggacgcctacgacggcaaggattacatcgccctgaacgaggacctgagctcctggaccgcggcg gacaccgcggctcagatcacccagcgcaagtgggaggcggcccgtgtggcggagcaggaCagagcctacctggagggccT gtgcgtggagtcgctccgcagatacctggagaacgggaaggagacgctgcagcgcgcggaccccccaaagacacatgtga cccaccacccatctctgaccatgaggTcaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagCtcaggtgga

B*4410

(SEQ ID NO: 1496)

gctcccactccatgaggtatttctacaccgccatgtcccggcccggccgcggggagcccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagaacctgcgcaccg cgctccgctactacaaccagagcgaggccgggtctcacatcatccagaggatgtTtggctgcgacctggggcccgacggg cgcctcctccgcgggcataaccagttagcctacgacggcaaggattacatcgccctgaacgaggacctgagctcctggac cgcggcggacaccgcggctcagatcacccagcgcaagtgggaggcggcccgtgtggcggagcagcTgagagcctacctgg agggcctgtgcgtggagtcCgctccgcagatacctggagaacgggaaggagacgctgcagcgcgcGg

B*4411

(SEQ ID NO: 1497)

gctcccactccatgaggtatttctacaccgccAtgtcccggcccggccgcggggagccccgcttcatcaccgtgggctac gtggacgacacgctgttcgtgaggttcgacagcgacgccAcgagtccgaggaaggagccgcgggcgccAtggatagagca ggaggggccggagtattgggaccgggaGacacagatctccaagaccaacacacagacttaccgagagaacctgcgcaCcc cgctcCgctactacaaccagagcgaggccgggtctcacatcAtccagaggatgtacggctgcgacgtggggccggacggg cgcctcctccgcgggTatgaccagGacgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggccTgtgcgtggagtCgctccgcagatacctggagaacgggaaggagacgctgcagcgcgcGg

B*4412

(SEQ ID NO: 1498)

gctcccactccatgaggtatttctacaccgccAtgtcccggcccggccgcggggagccccgcttcatcaccgtgggctac gtggacgacacgctgttcgtgaggttcgacagcgacgccAcgagtccgaggaaggagccgcgggcgccAtggatagagca ggaggggccggagtattgggaccggaacacacagatctccaagaccaacacacagacttaccgagagaacctgcgcaCcG cgctcCgctactacaaccagagcgaggccgggtctcacatcAtccagaggatgtacggctgcgacgtggggccggacggg cgcctcctccgcgggTatgaccagGacgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggccTgtgcgtggagtCgctccgcagatacctggagaacgggaaggagacgctgcagcgcgcGg

B*4413

(SEQ ID NO: 1499)

atgcgggtcacggcgccccgaaccctcctcctgctgctctgggggggcagtggccctgaccgagacctgggccggctccca ctccatgaggtatttctacaccgccatgtcccggcccggccgcggggagccccgcttcatcaccgtgggctacgtggacg acacgctgttcgtgaggttcgacagcgacgccacgagtccgaggaaggagccgcgggcgccatggatagagcaggagggg ccggagtattgggaGcggagacacagatctccaagaccaacacacagacttaccgagagaacctgcgcaccgcgctccg ctactacaaccagagcgaggccgggtctcacatcatccagaggatgtacggctgcgacgtggggccggacgggcgcctcc tccgcgggtatgaccaggacgcctacgacggcaaggattacatcgccctgaacgaggacctgagctcctggaccgcggcg gacaccgcggctcagatcacccagcgcaagtgggaggcggcccgtgtggcggagcagctgagagcctacctggagggcct gtgcgtggagtcgctccgcagatacctggagaacgggaaggagacgctgcagcgcgcggaccccccaaagacacatgtga cccaccaccccatctctgaccatgaggtcaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgcccttctggagaagagcagagatacacatgccatgtacagcatgaggggctgccgaagcccc tcaccctgagatgggagccgtcttcccagtccaccgtccccatcgtgggcattgttgctggcctggctgtcctagca gttgtggtcatcggagctgtggtcgctgctgtgatgtgtaggaggaagagctcaggtgga

B*4414

(SEQ ID NO: 1500)

gctcccactccatgaggtatttctacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagaacctgcgcaccg cgctccgctactacaaccagagcgaggccgggtctcacatcatccagaggatgtacggctgcgacgtggggccggacggg cgcctcctccgcgggcatAaccagGacgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggccTgtgcgtggagtCgctccgcagatacctggagaacgggaaggagacgctgcagcgcgcGg

B*4415

(SEQ ID NO: 1501)

gctcccactccatgaggtatttccacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagagcctgcgcaCcg cgctcCgctactacaaccagagcgaggccgggtctcacacttggcagaggatgtatggctgcgacctggggcccgacggg cgcctcctccgcgggTataaccagttAgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggcctgtgcgtggagtCgctccgcagatacctggagaacgggaaggagacgctgcagcgcgcGg

B*4416

(SEQ ID NO: 1502)

gctcccactccatgaggtatttctacaccgccAtgtcccggcccggccgcggggagccccgcttcatcaccgtgggctac gtggacgacacgctgttcgtgaggttcgacagcgacgccAcgagtccgaggaaggagccgcgggcgccAtggatagagca ggaggggccggagtattgggaccgggaGacacagatctccaagaccaacacacagacttaccgagagaacctgcgCaccG cgctccgctactacaaccagagcgaggccgggtctcacatcAtccagaggatgtacggctgcgacgtggggccggacggg cgcctcctccgcgggTatgaccagGacgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggcgagtgcgtggagtggctccgcagatacctggagaacgggaaggagacgctgCagcgcgcGg

B*4417

(SEQ ID NO: 1503)

gctcccactccatgaggtatttctacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagaacctgcgcaccg cgctccgctactacaaccagagcgaggccgggtctcacatcatccagaggatgtacggctgcgacgtggggccggacggg cgcctcctccgcgggcatgaccagtCcgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggccTgtgcgtggagtCgctccgcagatacctggagaacgggaaggagacgctgcagcgcgcGg

B*4418

(SEQ ID NO: 1504)

atgcgggtcacggcaccccgaaccgtcctcctgctgctctcggcggccctggccctgaccgagacctgggccggctccca ctccatgaggtatttccacaccgccatgtcccggcccggccgcggggagccccgcttcatcaccgtgggctacgtggacg acacgctgttcgtgaggttcgacagcgacgccacgagtccgaggaaggagccgcgggcgccatggatagagcaggagggg ccggagtattgggaccgggagacacagatctccaagaccaacacacagacttaccgagagaacctgcggaTcgcgctcCg ctactacaaccagagcgaggccgggtctcacacttggcagaggatgtatggctgcgacctggggcccgacgggcgcctcc tccgcgggTataaccagttAgcctacgacggcaaggattacatcgccctgaacgaggacctgagctcctggaccgcggcg gacaccgcggctcagatcacccagcgcaagtgggaggcggcccgtgtggcggagcaggaCagagcctacctggagggcct gtgcgtggagtCgctccgcagatacctggagaacgggaaggagacgctgcagcgcgcGg

B*4420

(SEQ ID NO: 1505)

gctcccactccatgaggtatttctacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagaacctgcgcaccg cgctccgctactacaaccagagcgaggccgggtctcacacttggcagacgatgtaTggctgcgacgtggggccggacggg cgcctcctccgcgggTatgaccagGacgcctacgacggcaaggattacatcgccctgaacgaggacctgagctcctggac

B*4421

(SEQ ID NO: 1506)

gctcccactccatgaggtatttctacaccgccAtgtcccggcccggccgcggggagccccgcttcatcaccgtgggctac gtggacgacacgctgttcgtgaggttcgacagcgacgccAcgagtccgaggaaggagccgcgggcgccAtggatagagca ggaggggccggagtattgggacccgggaGacacagatctccaagaccaacacacagacttaccgagagaacctgcgcaCcG cgctcCgctactacaaccagagcgaggccgggtctcacatcAtccagaggatgtacggctgcgacgtggggccggacggg cgcctcctccgcggGTatgaccagGacgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggcgagtgcgtggagtCgctccgcagatacctggagaacgggaaggagacgctgcagcgcgcGg

B*4422

(SEQ ID NO: 1507)

gctcccactccatgaggtatttctacaccgccgtgtcccggcccggccgcggggagccccgcttcatcaccgtgggctac gtggacgacacgctgttcgtgaggttcgacagcgacgccAcgagtccgaggaaggagccgcgggcgccAtggatagagca ggaggggccggagtattgggacccgggaGacacagatctccaagaccaacacacagacttaccgagagaacctgcgcaCcG cgctcCgctactacaaccagagcgaggccgggtctcacatcAtccagaggatgtacggctgcgacgtggggccggacggg cgcctcctccgcggGTatgaccagGacgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggccTgtgcgtggagtCgctccgcagatacctggagaacgggaaggagacgctgcagcgcgcGg

B*4424

(SEQ ID NO: 1508)

gctcccactccatgaggtatttctacaccgccatgtcccggcccggccgcggggagccccgcttcatcaccgtgggctac gtggacgacacgctgttcgtgaggttcgacagcgacgccacgagtccgaggaaggagccgcgggcgccgtgggtGgagca ggaggggccggagtattgggaccgggagacacagatctccaagaccaacacacagacttaccgagagaacctgcgcaccg cgctccgctactacaaccagagcgaggccgggtctcacatcatccagaggatgtacggctgcgacgtggggccggacggg cgcctcctccgcgggtatgaccaggacgcctacgacggcaaggattacatcgccctgaacgaggacctgagctcctggac cgcggcggacaccgcggctcagatcacccagcgcaagtgggaggcggcccgtgtggcggagcaggacagagcctacctgg agggcctgtgcgtggagtCgctccgcagatacctggagaacgggaaggagacgctgcagcgcgcGg

B*4425

(SEQ ID NO: 1509)

gctcccactccatgaggtatttctacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctCcaagaccaacacacagacttaccgagagaacctgcggaTcG cgctcCgctactacaaccagagcgaggccgggtctcacatcAtccagaggatgtacggctgcgacgtggggccggacggg cgcctcctccgcgggTatgaccagtacgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggccTgtgcgtggagtCgctccgcagatacctggagaacgggaaggagacgctgcagcgcgcGg

B*4426

(SEQ ID NO: 1510)

gctcccactccatgaggtatttctacaccgccatgtcccggcccggccgcggggagccccgcttcatcaccgtgggctac gtggacgacacgctgttGgtgaggttcgacagcgacgccacgagtccgaggaaggagccgcgggcgccatggatagagca ggaggggccggagtattgggaccgggagacacagatctccaagaccaacacacagacttaccgagagaacctgcgcaccg cgctccgctactacaaccagagcgaggccgggtctcacatcatccagaggatgtacggctgcgacgtggggccggacggg cgcctcctccgcgggtatgaccaggacgcctacgacggcaaggattacatcgccctgaacgaggacctgagctcctggac

```
cgcggcggacaccgcggctcagatcacccagcgcaagtgggaggcggcccgtgtggcggagcagctgagagcctacctgg agggcctgtgcgtggagtcgctccgcagatacctggagaacgggaaggagacgctgcagcgcgcgg
```

B*4427

(SEQ ID NO: 1511)

```
gctcccactccatgaggtatttctacaccgccatgtcccggcccggccgcggggagccccgcttcatcaccgtgggctac gtggacgacacgctgttcgtgaggttcgacagcgacgccAcgagtccgaggaaggagccgcgggcgccatggatagagca ggaggggccggagtattgggaccgggagacacagatctccaagaccaacacacagacttaccgagagaacctgcgcaccg cgctcCgctactacaaccagagcgaggccgggtctcacatcatccagaggatgtacggctgcgacgtggggccggacggg cgcctcctccgcgggtatgaccagGacgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggccTgtgcgtggagtCgctccgcagatacctggagaacgggaaggagacgctgcagcgcgcggaccccccaaagaca catgtgacccaccacccatctctgaccatgaggccaccctgaggtgctgggccctgggcttctaccctgcggagatcac actgacctggcagcgggatggcgaggaccaaactcaggacacCgagcttgtggagaccagaccagcaggagatagaacct tccagaagtgggcagctgtggtggtgccttctggagaagagcagagatacacatgccatgtacagcatgaggggctgccg aagcccctcaccctgagatggg
```

B*4428

(SEQ ID NO: 1512)

```
gctcccactccatgaggtatttctacaccgccatgtcccggcccggccgcggggagccccgcttcatcaccgtgggctac gtggacgacacgctgttcgtgaggttcgacagcgacgccAcgagtccgaggaaggagccgcgggcgccatggatagagca ggaggggccggagtattgggaccgggagacacagatctccaagaccaacacacagacttaccgagagaacctgcgcaccg cgctccgctactacaaccagagcgaggccgggtctcacatcAtccagaggatgtaTggctgcgacgtggggccggacggg cgcctcctccgcgggTatgaccagGacgcctacgacggcaaggattacatcgccctgaacgaggacctgagctcctggac cgcggcggacacCgcggctcagatcacccagcgcaagtgggaggcggcccgtgTggcggagcagcggagagcctacctgg agggccTgtgcgtggagtCgctccgcagatacctggagaacgggaaggagacgctgcagcgcgcGg
```

B*4429

(SEQ ID NO: 1513)

```
gctcccactccatgaggtatttctacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagaacctgcgcaccg cgctccgctactacaaccagagcgaggccgggtctcacatcatccagaggatgtacggctgcgacgtggggccggacggg cgcctcctccgcgggtatgaccaggacgcctacgacggcaaggattacatcgccctgaacgaggacctgagctcctggac cgcggcggacaccgcggctcagatcacccagcgcaagtgggaggcggcccgtgtggcggagcagctgagaAcctacctgg agggcctgtgcgtggagtCgctccgcagatacctggagaacgggaaggagacgctgcagcgcgcGg
```

B*4430

(SEQ ID NO: 1514)

```
gctcccactccatgaggtatttctacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagaacctgcgcaccg cgctccgctactacaaccagagcgaggccgggtctcacatcatccagaggatgtacggctgcgacgtggggccggacggg cgcctcctccgcgggtatgaccaggacgcctacgacggcaaggattacatcgccctgaacgaggacctgagctcctggac cgcggcggacaccgcggctcagatcacccagcgcaagtgggaggcggcccgtgtggcggagcagctgagagcctacctgg agggcctgtgcgCggagtcgctccgcagatacctggagaacgggaaggagacgctgcagcgcgcgg
```

B*4431

(SEQ ID NO: 1515)

```
atgcgggtcacggcgccccgaaccctcctcctgctgctctgggggggcagtggccctgaccgagacctgggccggctccca ctccatgaggtatttctacaccgccatgtcccggcccggccgcggggagccccgcttcatcaccgtgggctacgtggacg
```

-continued acacgctgttcgtgaggttcgacagcgacgccacgagtccgaggaaggagccgcgggcgccatggatagagcaggagggg ccggagtattgggaccggagacacagatctccaagaccaacacacagacttaccgagagaacctgcgcaccgcgctccg ctactacaaccagagcgaggccgggtctcacaccctccagaggatgtacggctgcgacgtggggccggacgggcgcctcc tccgcgggcataaccagtacgcctacgacggcaaggattacatcgccctgaacgaggacctgcgctcctggaccgccgcg gacacggcggctcagatctcccagcgcaagtTggaggcggcccgtgtggcggagcagctgagagcctacctggagggcga gtgcgtggagtCgctccgcagatacctggagaacgggaaggacaagctggagcgcgctgacccccaaagacacacgtga cccaccacccatctctgaccatgaggccaccctgaggtgctgggccctgggtttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatggg

B*4432

(SEQ ID NO: 1516)
gctcccactccatgaggtatttctacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccCggagacacagatctccaagaccaacacacagacttaccgagagaacctgcgcaccg cgctccgctactacaaccagagcgaggccgggtctcacatcatccagaggatgtacggctgcgacgtggggccggacggg cgcctcctccgcgggtatgaccaggacgcctacgacggcaaggattacatcgccctgaacgaggacctgagctcctggac cgcggcggacaccgcggctcagatcacccagcgcaagtgggaggcggcccgtgtggcggagcagctgagagcctacctgg agggcctgtgcgtggagtCgctccgcagatacctggagaacgggaaggagacgctgcagcgcgcgg

B*4433

(SEQ ID NO: 1517)
gctcccactccatgaggtatttctacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagaacctgcgcaccg cgctccgctactacaaccagagcgaggccgggtctcacatcatccagaggatgtacggctgcgacgtggggccggacggg cgcctcctccgcgggtatgaccaggacgcctacgacggcaaggattacatcAccctgaacgaggacctgagctcctggac cgcggcggacaccgcggctcagatcacccagcgcaagtgggaggcggcccgtgtggcggagcaggacagagcctacctgg agggcctgtgcgtggagtcgctccgcagatacctggagaacgggaaggagacgctgcagcgcgcgg

B*4501

(SEQ ID NO: 1518)
atgcgggtcacggcaccccgaaccgtcctcctgctgctctcggcggccctggccctgaccgagacctgggccggctccca ctccatgaggtatttccacaccgccatgtcccggcccggccgcggggagccccgcttcatcaccgtgggctacgtggacg acacgctgttcgtgaggttcgacagcgacgccacgagtccgaggaaggagccgcgggcgccatggatagagcaggagggg ccggagtattgggaccggagacacagatctccaagaccaacacacagacttaccgagagagcctgcggaacctgcgcgg ctactacaaccagagcgaggccgggtctcacacttggcagaggatgtatggctgcgacctggggcccgacgggcgcctcc tccgcgggTataaccagttAgcctacgacggcaaggattacatcgccctgaacgaggacctgagctcctggaccgcggcg gacaccgcggctcagatcacccagcgcaagtgggaggcggcccgtgtggcggagcaggaCagagcctacctggagggcct gtgcgtggagtCgctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcaggtgga

B*4502

(SEQ ID NO: 1519)
gctcccactccatgaggtatttccacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagactTaccgagagagcctgcggaacc tgcgcggctactacaaccagagcgaggccgggtctcacacttggcagaggatgtatggctgcgacctggggcccgacggg cgcctcctccgcgggTataaccagtTcgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggccTgtgcgtggagtCgctccgcagatacctggagaacgggaaggagacgctgcagcgcgcGg

B*4503

(SEQ ID NO: 1520)
gctcccactccatgaggtatttccacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggccgggtctcacacttggcagaggatgtatggctgcgacctggggcccgacggg cgcctcctccgcgggtataaccGgttagcctacgacggcaaggattacatcgccctgaacgaggacctgagctcctggac cgcggcggacaccgcggctcagatcacccagcgcaagtgggaggcggcccgtgtggcggagcaggacagagcctacctgg agggcctgtgcgtggagtcgctccgcagatacctggagaacgggaaggagacgctgcagcgcgcgg

B*4504

(SEQ ID NO: 1521)
atgcgggtcacggcaccccgaaccgtcctcctgctgctctcggcggccctggccctgaccgagacctgggccggctccca ctccatgaggtatttccacaccgccatgtcccggcccggccgcggggagccccgcttcatcaccgtgggctacgtggacg acacgctgttcgtgaggttcgacagcgacgccacgagtccgaggaaggagccgcgggcgccatggatagagcaggagggg ccggagtattgggaccgggagacacagatctccaagaccaacacacagacttaccgagagagcctgcggaacctgcgcgg ctactacaaccagagcgaggccgggtctcacacttggcagaggatgtatggctgcgacctggggcccgacgggcgcctcc tccgcgggTataaccagttAgcctacgacggcaaggattacatcgccctgaacgaggacctgagctcctggaccgcggcg gacaccgcggctcagatcacccagcgcaagtgggaggcggcccgtgtggcggagcaggaCagagcctacctggagggcct gtgcgtggagtggctccgcagatacctggagaacgggaaggagacgctgcagcgcgcggacccccaaagacacatgtga cccaccaccccatctctgaccatgaggccaccctgaggtgctgggccctgggcttctaccctgcggagatcacactgacc tggcagcgggatggcgaggaccaaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcaggtgga

B*4505

(SEQ ID NO: 1522)
gctcccactccatgaggtatttccacaccgccatgtcccggcccggccgcggggagccccgcttcatcaccgtgggctac gtggacgacacgctgttcgtgaggttcgacagcgacgccacgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggccgggtctcacacttggcagaggatgtatggctgcgacctggggcccgacggg cgcctcctccgcgggtataaccagttagcctacgacggcaaggattacatcgccctgaacgaggacctgagctcctggac cgcggcggacaccgcggctcagatcacccagcgcaagtgggaggcggcccgtgtggcggagcaggacagagTctacctgg agggcctgtgcgtggagtcgctccgcagatacctggagaacgggaaggagacgctgcagcgcg

B*4506

(SEQ ID NO: 1523)
gctcccactccatgaggtatttccacaccgccatgtcccggcccggccgcggggagccccgcttcatcaccgtgggctac gtggacgacacgctgttcgtgaggttcgacagcgacgccacgagtccgaggaaggagccgcgggcgccatggatagagca -continued ggaggggccggagtattgggaccgggagacacagatctacaaggcccaggcacagactgaccgagagagcctgcggaacc tgcgcggctactacaaccagagcgaggccgggtctcacacttggcagaggatgtatggctgcgacctggggcccgacggg cgcctcctccgcgggTataaccagttAgcctacgacggcaaggattacatcgccctgaacgaggacctgagctcctggac cgcggcggacaccgcggctcagatcacccagcgcaagtgggaggcggcccgtgtggcggagcaggaCagagcctacctgg agggcctgtgcgtggagtCgctccgcagatacctggagaacgggaaggagacgctgcagcgcgcGg B*4601
(SEQ ID NO: 1524)
atgcgggtcacggcgccccgaaccgtcctcctgctgctctcgggagccctggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgcccgggcgccatggatagagcaggaggg ccggagtattgggaccgggagacacagaagtacaagCgccaggcacagactgaccgagtgagcctgcggaacctgcgcgg ctactacaaccagagcgaggccgggtctcacaccctccagaggatgtacggctgcgacgtggggccggacgggcgcctcc tccgcgggcatgaccagtccgcctacgacggcaaggattacatcgccctgaacgaggacctgagctcctggaccgcggcg gacacggcggctcagatcacccagcgcaagtgggaggcggcccgtgaggcggagcagtggagagcctacctggagggcct gtgcgtggagtggctccgcagatacctggagaacgggaaggagacgctgcagcgcgcggacccccccaaagacacatgtga cccaccacccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatcccatcgtgggcattgttgctggcctggctgtccta...gca gttgtggtcatcggagctgtggtcgctactgtgatgtgtaggaggaagagCtcaggtgga B*4602
(SEQ ID NO: 1525)
gctcccactccatgaggtatttctacaccgccatgtcccggcccggccgcggggagccccgcttcatcgcagtgggctac gtggacgacacccagttcgtgaggttcgacagcgacgccgcgagtccgaggatggcgcccgggcgccatggatagagca ggaggggccggagtattgggaccgggagacacagaagtacaagcgccaggcacagactgGccgagtgagcctgcggaacc tgcgcggctactacaaccagagcgaggccgggtctcacaccctccagaggatgtacggctgcgacgtggggccggacggg cgcctcctccgcggcatgaccagtccgcctacgacggcaaggattacatcgccctgaacgaggacctgagctcctggac cgcggcggacacggcggctcagatcacccagcgcaagtgggaggcggcccgtgaggcggagcagtggagagcctacctgg agggcctgtgcgtggagtggctccgcagatacctggagaacgggaaggagacgctgcagcgcgcgg B*470101
(SEQ ID NO: 1526)
atgcgggtcacggcgccccgaaccctcctcctgctgctctgggggcagtggccctgaccgagacctgggctggctccca ctccatgaggtatttctacaccgccatgtcccggcccggccgcggggagccccgcttcatcaccgtgggctacgtggacg acacgctgttcgtgaggttcgacagcgacgccacgagtccgaggaaggagccgcgggcgccatggatagagcaggaggg ccggagtattgggaccgggagacacagatctccaagaccaacacacagacttaccgagaggacctgcggaccctgctccg ctactacaaccagagcgaggccgggtctcacaccctccagaggatgtttggctgcgacgtggggccggacgggcgcctcc tccgcgggtaccaccaggacgcctacgacggcaaggattacatcgccctgaacgaggacctgagctcctggaccgccgcg gacacggcggctcagatcacccagcgcaagtgggaggcggcccgtgtggcggagcagctgagagcctacctggagggcga gtgcgtggagtggctccgcagatacctggagaacgggaaggagacgctgcagcgcgcggacccccccaaagacacacgtga cccaccacccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca
gttgtggtcatcggagctgtggtcgctgctgtgGtgtgtaggaggaagagctcaggtgga B*4702 (SEQ ID NO: 1527)
gcgggtcacggcgccccgaaccctcctcctgctgctctgggggcagtggccctgaccgagacctgggctggctcccact
ccatgaggtatttctacaccgccatgtcccggcccggccgcggggagccccgcttcatcaccgtgggctacgtggacgac
acgctgttcgtgaggttcgacagcgacgccacgagtccgaggaaggagccgcgggcgccatggatagagcaggaggggcc
ggagtattgggaccgggagacacagatctccaagaccaacacacagacttaccgagagagcctgcggaacctgcgcggct
actacaaccagagcgaggccgggtctcacaccctccagaggatgtTtggctgcgacgtggggccggacgggcgcctcctc
cgcgggtaccaccaggacgcctacgacggcaaggattacatcgccctgaacgaggacctgagctcctggaccgccgcgga
cacggcggctcagatcacccagcgcaagtgggaggcggcccgtgTggcggagcagcTgagagcctacctggagggcgagt
gcgtggagtggctccgcagatacctggagaacgggaaggagacgctgcagcgcgcggacccccccaaagacacacgtgacc
caccacccatctctgaccatgaggccaccctgaggtgctgggccctgggCttctaccctgcggagatcacactgacctg
gcagcgggatggcgaggaccaaactcaggacactgagcttgtggagaccagaccagcaggagatagaaccttccagaagt
gggcagctgtggtggtgccttctggagaagagcagagatacacatgccatgtacagcatgaggggctgccgaagcccctc
accctgagatgggagccgtcttcc B*4703 (SEQ ID NO: 1528)
gctcccactccatgaggtatttctacaccgccatgtcccggcccggccgcggggagccccgcttcatcaccgtgggctac
gtggacgacacgctgttcgtgaggttcgacagcgacgccacgagtccgaggaaggagccgcgggcgccatggatagagca
ggaggggccggagtattgggaccgggagacacagatctccaagaccaacacacagacttaccgagagagcctgcggaacc
tgctcCgctactacaaccagagcgaggccgggtctcacaccctccagaggatgtTtggctgcgacgtggggccggacggg
cgcctcctccgcgggtaccaccagGacgcctacgacggcaaggattacatcgccctgaacgaggacctgagctcctggac
cgccgcggacacggcggctcagatcacccagcgcaagtgggaggcggcccgtgTggcggagcagcTgagagcctacctgg
agggcgagtgcgtggagtggctccgcagatacctggagaacgggaaggagacgctgcagcgcgcgGg B*4704 (SEQ ID NO: 1529)
gctcccactccatgaggtatttctacaccgccatgtcccggcccggccgcggggagccccgcttcatcaccgtgggctac
gtggacgacacgctgttcgtgaggttcgacagcgacgccacgagtccgaggaaggagccgcgggcgccatggatagagca
ggaggggccggagtattgggaccgggagacacagatctccaagaccaacAcacagacttaccgagagaacctgcgcaCcg
CgctcCgctactacaaccagagcgaggccgggtctcacaccctccagaaTatgtatggctgcgacgtggggccggacggg
cgcctcctccgcgggtaccaccagGacgcctacgacggcaaggattacatcgccctgaacgaggacctgagctcctggac
cgccgcggacacggcggctcagatcacccagcgcaagtgggaggcggcccgtgTggcggagcagcTgagagcctacctgg
agggcgagtgcgtggagtggctccgcagatacctggagaacgggaaggagacgctgcagcgcgcGg B*4801 (SEQ ID NO: 1530)
atgctggtcatggcgccccgaaccgtcctcctgctgctctcggcggccctggccctgaccgagacctgggccggctccca
ctccatgaggtatttctacacctccgtgtcccggcccggccgcggggagccccgcttcatctcagtgggctacgtggacg
acacccagttcgtgaggttcgacagcgacgccgcgagtccgagagaggagccgcgggcgccgtggatagagcaggaggg
ccggagtattgggaccgggagacacagatctccaagaccaacacacagactTaccgagagagcctgcggaacctgcgcgg
ctactacaaccagagcgaggccgggtctcacaccctccagagcatgtacggctgcgacgtggggccggacgggcgcctcc
tccgcgggcataaccagtacgcctacgacggcaaggattacatcgccctgaacgaggacctgcgctcctggaccgccgcg
gacacggcggctcagatctcccagcgcaagtgggaggcggcccgtgtggcggagcagctgagagcctacctggagggcga
gtgcgtggagtggctccgcagatacctggagaacgggaaggacaagctggagcgcgctgaccccccaaagacacacgtga -continued cccaccaccccatctctgaccatgaggccaccctgaggtgctgggccctgggtttctaccctgcggagatcacactgacc tggcagcgggatggcgaggaccaaactcaggacactgagcttgtggagaccagaccagcaggagatagaaccttccagaa gtggAcagctgtggtggtgccttctggagaagagcagagatacacatgccatgtacagcatgaggggctgccgaagcccc tcaccctgagatgggagccgtcttcccagtccaccgtccccatcgtgggcattgttgctggcctggctgtccta...gca gttgtggtcatcggagctgtggtcgctgctgtgatgtgtaggaggaagagttcaggtgga

B*4802

(SEQ ID NO: 1531)
gtcctcctgctgctctcggcggccctggccctgaccgagacctgggccggctcccactccatgaggtatttctacacctc cgtgtcccggcccggccgcggggagccccgcttcatctcagtgggctacgtggacgacacccagttcgtgaggttcgaca gcgacgccgcgagtccgagagaggagccgcgggcgccgtggatagagcaggaggggccggagtattgggaccgggagaca cagatctCcaagaccaacAcacagacttaccgagagagcctgcggaacctgcgcggctactacaaccagagcgaggccgg gtctcacatcAtccagaggatgtaTggctgcgacctggggcccgacgggcgcctcctccgcgggcatgaccagtCcgcct acgacgcaaggattacatcgccctgaacgaggacctgAgctcctggaccgcggcggacaccgcggctcagatcacccag cgcaagtgggaggcggcccgtgTggcggagcagcTgagagcctacctggagggcCtgtgcgtggagtggctccgcagata cctggagaacgggaaggagacgctgcagcgcgcggacccccccaaagacacacgtgacccaccaccccGtctctgaccatg aggccaccctgaggtgctgggccctgggcttctaccctgcggagatcacactgacctggcagcgggatggcgaggaccaa actcaggacactgagcttgtggagaccagaccagcaggagatagaaccttccagaagtgggcagctgtggtggtgccttc tggagaagagcagagatacacatgccatgtacagcatgaggggctgccgaagcccctcaccctgagatgggagccatctt cccagtccaccatcccatcgtgggcattgttgctggcctggctgtccta...gcagttgtggtcatcggagctgtggtc gctactgtgatgtgtaggaggaagagCtcaggtgga

B*4803

(SEQ ID NO: 1532)
gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccgggaGacacagatctCcaagaccaacacacagactTaccgagagagcctgcggaacc tgcgcggctactacaaccagagcgaggccgggtctcacaccctccagagGatgtacggctgcgacgtggggccggacggg cgcctcctccgcgggcatAaccagtacgcctacgacggcaaggattacatcgccctgaacgaggacctgcgctcctggac cgccgcggacacggcggctcagatctcccagcgcaagtTggaggcggcccgtgTggcggagcagctgagagcctacctgg agggcgagtgcgtggagtggctccgcagatacctggagaacgggaaggacaagctggagcgcgctg

B*4804

(SEQ ID NO: 1533)
gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggaggggccggagtattgggaccgggagacacagatctccaagaccaacacacagacttaccgagagagcctgcggaacc tgcgcggctactacaaccagagcgaggccgggtctcacaccctccagagcatgtacggctgcgacgtggggccggacggg cgcctcctccgcgggcataaccagtacgcctacgacggcaaggattacatcgccctgaacgaggacctgcgctcctggac cgccgcggacacggcggctcagatctcccagcgcaagttggaggcggcccgtgtggcggagcagctgagagcctacctgg agggcgagtgcgtggagtggctccgcagatacctggagaacgggaaggagacgctgcagcgcgcGgaccccccaaagaca cacgtgacccaccaccccatctctgaccatgaggccaccctgaggtgctgggccctggtttctaccctgcggagatcac actgacctggcagcgggatggcgaggaccaaactcaggacactgagcttgtggagaccagaccagcaggagatagaacct tccagaagtggAcagctgtggtggtgccttctggagaagagcagagatacacatgccatgtacagcatgaggggctgccg aagcccctcaccctgagatggg

B*4805

(SEQ ID NO: 1534)

atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcCgtgggctacgtggacg acacccagttcgtgaggttcgacagcgacgccgcgagtccgagagaggagccgcgggcgccgtggatagagcaggagggg ccggagtattgggaccgggaGacacagatctCcaagaccaacacacagactTaccgagagagcctgcggaacctgcgcgg ctactacaaccagagcgaggccgggtctcacaccctccagagcatgtacggctgcgacgtggggccggacgggcgcctcc tccgcgggcatAaccagtacgcctacgacggcaaggattacatcgccctgaacgaggacctgcgctcctggaccgccgcg gacacggcggctcagatcacccagcgcaagtgggaggcggcccgtgaggcggagcagcggagagcctacctggagggcga gtgcgtggagtggctccgcagatacctggagaacgggaaggacaagctggagcgcgctg

B*4806

(SEQ ID NO: 1535)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggagggggccggagtattgggaccggaacacacagatctTcaagaccaacacacagactTaccgagagagcctgcggaacc tgcgcggctactacaaccagagcgaggccgggtctcacaccctccagagcatgtacggctgcgacgtggggccggacggg cgcctcctccgcgggcatAaccagtacgcctacgacggcaaggattacatcgccctgaacgaggacctgcgctcctggac cgccgcggacacggcggctcagatctcccagcgcaagtTggaggcggcccgtgTggcggagcagctgagagcctacctgg agggcgagtgcgtggagtggctccgcagatacctggagaacgggaaggacaagctggagcgcgctg

B*4807

(SEQ ID NO: 1536)

gctcccactccatgaggtatttctacacctccgtgtcccggcccggccgcggggagccccgcttcatctcagtgggctac gtggacgacacccagttcgtgaggttcgacagcgacgccgcgagtccgagagaggagccgcgggcgccgtggatagagca ggagggggccggagtattgggaccgggagacacagatctccaagaccaacacacagacttaccgagagagcctgcggaacc tgcgcggctactacaaccagagcgaggccgggtctcacaccctccagagcatgtacggctgcgacgtggggccggacggg cgcctcctccgcgggcataaccagtTcgcctacgacggcaaggattacatcgccctgaacgaggacctgcgctcctggac cgccgcggacacggcggctcagatctcccagcgcaagtTggaggcggcccgtgTggcggagcagctgagagcctacctgg agggcgagtgcgtggagtggctccgcagatacctggagaacgggaaggacaagctggagcgcgctg

B*4901

(SEQ ID NO: 1537)

atgcgggtcacggcaccccgaaccgtcctcctgctgctctcggcggccctggccctgaccgagacctgggccggctccca ctccatgaggtatttccacacctccatgtcccggcccggccgcggggagccccgcttcatcaccgtgggctacgtggacg acacgctgttcgtgaggttcgacagcgacgccgcacgagtccgaggaaggagccgcgggcgccatggatagagcaggagggg ccggagtattgggaccgggagacacagatctccaagaccaacacacagacttaccgagagaacctgcggatcgcgctcCg ctactacaaccagagcgaggccgggtctcacacttggcagaggatgtatggctgcgacctggggcccgacgggcgcctcc tccgcgggtataaccagttAgcctacgacggcaaggattacatcgccctgaacgaggacctgagctcctggaccgcggcg gacaccgcggctcagatcacccagcgcaagtgggaggcggcccgtgaggcggagcagcTgagagcctacctggagggcct gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtcctaa...gca gttgtggtcatcggagctgtggtcgctActgtgatgtgtaggaggaagagCtcaggtgga

B*4902

(SEQ ID NO: 1538)

tcccactccatgaggtatttccacaccgccatgtcccggcccggccgcggggagccccgcttcatcaccgtgggctacgt ggacgacacgctgttcgtgaggttcgacagcgacgccacgagtccgaggaaggagccgcgggcgccatggatagagcagg aggggccggagtattgggaccgggagacacagatctccaagaccaacacacagacttaccgagagaacctgcgcaCcgcg ctcCgctactacaaccagagcgaggccgggtctcacacttggcagaggatgtatggctgcgacctggggcccgacgggcg cctcctccgcgggtataaccagttAgcctacgacggcaaggattacatcgccctgaacgaggacctgagctcctggaccg cggcggacaccgcggctcagatcacccagcgcaagtgggaggcggcccgtgaggcggagcagcTgagagcctacctggag ggcctgtgcgtggagtggctccgcagatacctggagaacgggaaggagacgctgcagcgcgcggaccccccaaagacaca tgtgacccaccaccccatctctgaccatgaggccaccctgaggtgctgggccctgggcttctaccctgcggagatcacac tgacctggcagcgggatggcgaggaccaaactcaggacacCgagcttgtggagaccagaccagcaggagatagaaccttc cagaagtgggcagctgtggtggtgccttctggagaagagcagagatacacatgccatgtacagcatgaggggctgccgaa gccccthaccctgagatggg

B*4903

(SEQ ID NO: 1539)

gctcccactccatgaggtatttccacaccgccatgtcccggcccggccgcggggagccccgcttcattgcagtgggctac gtggacgacacccagttcgtgaggttcgacagcgacgccgcgagtccgaggacggagccCgggcgccatggatagagca ggaggggccggagtattgggaccgggagacacagatctccaagaccaacacacagacttaccgagagaacctgcggaTcg cgctcCgctactacaaccagagcgaggccgggtctcacacttggcagaggatgtatggctgcgacCtggggcccgacggg cgcctcctccgcgggTataaccagttAgcctacgacggcaaggattacatcgccctgaacgaggacctgagctcctggac cgcggcggacaccgcggctcagatcacccagcgcaagtgggaggcggcccgtgaggcggagcagcTgagagcctacctgg agggccTgtgcgtggagtggctccgcagatacctggagaacgggaaggagacgctgcagcgcgcGg

B*5001

(SEQ ID NO: 1540)

atgcgggtcacggcaccccgaaccgtcctcctgctgctctcggcggccctggccctgaccgagacctgggccggctccca ctccatgaggtatttccacaccgccatgtcccggcccggccgcggggagccccgcttcatcaccgtgggctacgtggacg acacgctgttcgtgaggttcgacagcgacgccacgagtccgaggaaggagccgcgggcgccatggatagagcaggagggg ccggagtattgggaccgggagacacagatctccaagaccaacacacagacttaccgagagagcctgcggaacctgcgcgg ctactacaaccagagcgaggccgggtctcacacttggcagaggatgtatggctgcgacctggggcccgacgggcgcctcc tccgcgggtataaccagttAgcctacgacggcaaggattacatcgccctgaacgaggacctgagctcctggaccgcggcg gacaccgcggctcagatcacccagcgcaagtgggaggcggcccgtgaggcggagcagcTgagagcctacctggagggcct gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcaggtgga

B*5002

(SEQ ID NO: 1541)

atgcgggtcacggcaccccgaaccgtcctcctgctgctctcggcggccctggccctgaccgagacctgggccggctccca ctccatgaggtatttccacaccgccatgtcccggcccggccgcggggagccccgcttcatcaccgtgggctacgtggacg acacgctgttcgtgaggttcgacagcgacgccacgagtccgaggaaggagccgcgggcgccatggatagagcaggagggg ccggagtattgggaccgggagacacagatctccaagaccaacacacagacttaccgagagagcctgcggaacctgcgcgg ctactacaaccagagcgaggccgggtctcacacttggcagaggatgtatggctgcgacctggggcccgacgggcgcctcc -continued tccgcgggtataaccagttAgcctacgacggcaaggattacatcgccctgaacgaggacctgagctcctggaccgcggcg gacaccgcggctcagatcacccagcgcaagtgggaggcggcccgtgaggcggagcagcTgagagcctacctggagggcct gtgcgtggagtCgctccgcagatacctggagaacgggaaggagacgctgcagcgcgcggacccccaaagacacatgtga cccaccaccccatctctgaccatgaggccaccctgaggtgctgggccctgggcttctaccctgcggagatcacactgacc tggcagcgggatggcgaggaccaaactcaggacacCgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcaggtgga

B*5004

(SEQ ID NO: 1542)
gctcccactccatgaggtatttccacaccgccatgtcccggcccggccgcggggagccccgcttcatcaccgtgggctac gtggacgacacgctgttcgtgaggttcgacagcgacgccAcgagtccgaggaaggagccgcgggcgccatggatagagca ggaggggccggagtattgggaccgggagacacagatctccaagaccaacacacagacttaccgagagagcctgcggaacc tgcgcggctactacaaccagagcgaggccgggtctcacacttggcagaggatgtacggctgcgacgtggggcccgacggg cgcctcctccgcgggTataaccagttAgcctacgacggcaaggattacatcgccctgaacgaggacctgagctcctggac cgcggcggacaccgcggctcagatcacccagcgcaagtgggaggcggcccgtgaggcggagcagcTgagagcctacctgg agggccTgtgcgtggagtggctccgcagatacctggagaacgggaaggagacgctgcagcgcgcGg

B*510101

(SEQ ID NO: 1543)
atgcgggtcacggcgccccgaaccgtcctcctgctgctctgggggcagtggccctgaccgagacctgggccggctccca ctccatgaggtatttctacaccgccatgtcccggcccggccgcggggagccccgcttcatTgcagtgggctacgtggacg acacccagttcgtgaggttcgacagcgacgccgcgagtccgaggacggagccccgggcgccatggatagagcaggaggg ccggagtattgggaccggaacacacagatctTcaagaccaacacacagacttaccgagagaacctgcggatcgcgctcCg ctactacaaccagagcgaggccgggtctcacacttggcagaCgatgtatggctgcgacgtggggccggacgggcgcctcc tccgcgggcataaccagtacgcctacgacggcaaagattacatcgccctgaacgaggacctgagctcctggaccgcggcg gacaccgcggctcagatcacccagcgcaagtgggaggcggcccgtgaggcggagcagcTgagagcctacctggagggcct gtgcgtggagtggctccgcagaCacctggagaacgggaaggagacgctgcagcgcgcggacccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*510102

(SEQ ID NO: 1544)
atgcgggtcacggcgccccgaaccgtcctcctgctgctctgggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggacggagccccgggcgccatggatagagcaggaggg ccggagtattgggaccggaacacacagatctTcaagaccaacacacagacttaccgagagaacctgcggatcgcgctcCg ctactacaaccagagcgaggccgggtctcacacttggcagaCgatgtatggctgcgacgtggggccggacgggcgcctcc tccgcgggcataaccagtacgcctacgacggcaaagattacatcgccctgaacgaggacctgagctcctggaccgcggcg gacaccgcggctcagatcacccagcgcaagtgggaggcggcccgtgaggcggagcagcTgagagcctacctggagggcct gtgcgtggagtggctccgcagaCacctggagaacgggaaggagacgctgcagcgcgcggacccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa -continued gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*510103

(SEQ ID NO: 1545)

gctcccactccatgaggtatttctacaccgccatgtcccggcccggccgcggggagcccgcttcatTgcagtgggctac gtggacgacacccagttcgtgaggttcgacagcgacgccgcgagtccgaggacggagccccgggcgccgtggatagagca ggaggggccggagtattgggaccggaacacacagatctTcaagaccaacacacagacttaccgagagaacctgcggatcg cgctcCgctactacaaccagagcgaggccgggtctcacacttggcagaCgatgtaTggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*510104

(SEQ ID NO: 1546)

gctcccactccatgaggtatttctacaccgccatgtcccggcccggccgcggggagcccgcttcatTgcagtgggctac gtggacgacacccagttcgtgaggttcgacagcgacgccgcgagtccgaggacggagccccgggcgccAtggatagagca ggaggggccggagtattgggaccggaacacacagatctTcaagaccaacacacagacttaccgagagaacctgcggatcg cgctcCgctactacaaccagagcgaggccgggtctcacacttggcagaCgatgtaTggctgcgacgtggggccggacggg cgcctcctccgcgggcatAaccagtacgcctacgacggcaaggattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*510105

(SEQ ID NO: 1547)

atgcgggtcacggcgccccgaaccgtcctcctgctgctctgggggcagtggccctgaccgagacctgggccggctccca ctccatgaggtatttctacaccgccatgtcccggcccggccgcggggagcccgcttcattgcagtgggctacgtggacg acacccagttcgtgaggttcgacagcgacgccgcgagtccgaggacggagccccgggcgccatggatagagcaggagggg ccggagtattgggaccggaacacacagatcttcaagaccaacacacagacttaccgagagaacctgcggatcgcgctccg ctactacaaccagagcgaggccgggtctcacacttggcagacgatgtatggctgcgacgtggggccggacgggcgcctcc tccgcgggcataaccagtacgcctacgacggcaaagattacatcgccctgaacgaggacctgagctcctggaccgcggcg gacaccgcggctcagatcacccagcgcaagtgggaggcggcccgtgaggcggagcagctgagagcctacctggagggcct gtgcgtggagtggctccgcagacacctggagaacgggaaggagacgctgcagcgcgcggacccccccaaagacacaTgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcag

B*510201

(SEQ ID NO: 1548)

atgcgggtcacggcgccccgaaccgtcctcctgctgctctgggggcagtggccctgaccgagacctgggccggctccca ctccatgaggtatttctacaccgccatgtcccggcccggccgcggggagcccgcttcatTgcagtgggctacgtggacg acacccagttcgtgaggttcgacagcgacgccgcgagtccgaggacggagccccgggcgccatggatagagcaggagggg ccggagtattgggaccggaacacacagatctTcaagaccaacacacagacttaccgagagaacctgcggatcgcgctcCg ctactacaaccagagcgaggccgggtctcacacttggcagaCgatgtatggctgcgacgtggggccggacgggcgcctcc tccgcgggcataaccagtacgcctacgacggcaaAgattacatcgccctgaacgaggacctgAgctcctggaccgcggcg -continued

```
gacaccgcggctcagatcacccagcgcaagtgggaggcggcccgtgaggcggagcagcTgagagcctacctggagggccT gtgcgtggagtggctccgcagatacctggagaacgggaaggagacgctgcagcgcgcggaccccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga
```

B*510202                                                                                    (SEQ ID NO: 1549)
```
atgcgggtcacggcgccccgaaccgtcctcctgctgctctgggggcagtggccctgaccgagacctgggccggctccca ctccatgaggtatttctacaccgccatgtcccggcccggccgcggggagccccgcttcatcgcagtgggctacgtggacg acacccagttcgtggaggttcgacagcgacgccgcgagtccgaggacggagccccgggcgccatggatagagcaggagggg ccggagtattgggaccggaacacacagatctTcaagaccaacacacagacttaccgagagaacctgcggatcgcgctcCg ctactacaaccagagcgaggccgggtctcacacttggcagaCgatgtatggctgcgacgtggggccggacgggcgcctcc tccgcgggcataaccagtacgcctacgacggcaaAgattacatcgccctgaacgaggacctgAgctcctggaccgcggcg gacaccgcggctcagatcacccagcgcaagtgggaggcggcccgtgaggcggagcagcTgagagcctacctggagggccT gtgcgtggagtggctccgcagatacctggagaacgggaaggagacgctgcagcgcgcggaccccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga
```

B*5103                                                                                      (SEQ ID NO: 1550)
```
atgcgggtcacggcgccccgaaccgtcctcctgctgctctgggggcagtggccctgaccgagacctgggccggctccca ctccatgaggtatttctacaccgccatgtcccggcccggccgcggggagccccgcttcattgcagtgggctacgtggacg acacccagttcgtggaggttcgacagcgacgccgcgagtccgaggacggagccccgggcgccatggatagagcaggagggg ccggagtattgggaccggaacacacagatcttcaagaccaacacacagacttaccgagagaacctgcggatcgcgctccg ctactacaaccagagcgaggccgggtctcacacttggcagacgatgtatggctgcgacgtggggccggacgggcgcctcc tccgcgggcataaccagtacgcctacgacggcaaagattacatcgccctgaacgaggacctgagctcctggaccgcggcg gacaccgcggctcagatcacccagcgcaagtgggaggcggcccgtgaggcggagcagctgagagcctacctggagggcct gtgcgtggagGggctccgcagacacctggagaacgggaaggagacgctgcagcgcgcggaccccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagctcaggtgga
```

B*5104                                                                                      (SEQ ID NO: 1551)
```
atgcgggtcacggcgccccgaaccgtcctcctgctgctctgggggcagtggccctgaccgagacctgggccggctccca ctccatgaggtatttctacaccgccatgtcccggcccggccgcggggagccccgcttcattgcagtgggctacgtggacg acacccagttcgtggaggttcgacagcgacgccgcgagtccgaggacggagccccgggcgccatggatagagcaggagggg ccggagtattgggaccggaacacacagatcttcaagaccaacacacagacttaccgagagaacctgcggatcgcgctccg ctactacaaccagagcgaggccgggtctcacatcAtccagaggatgtatggctgcgacgtggggccggacgggcgcctcc
```

-continued tccgcgggcataaccagtacgcctacgacggcaaagattacatcgccctgaacgaggacctgagctcctggaccgcggcg gacaccgcggctcagatcacccagcgcaagtgggaggcggcccgtgaggcggagcagcTgagagcctacctggagggcct gtgcgtggagtggctccgcagaCacctggagaacgggaaggagacgctgcagcgcgcggaccccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatcccatcgtgggcattgttgctggcctggctgtccta...gca gttgtggtcatcggagctgtggtcgctactgtgatgtgtaggaggaagagCtcaggtgga B*5105
(SEQ ID NO: 1552)
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctcCgctactacaaccagagcgaggccgggtctcacacttggcagacgatgtatggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgTggcggagcagcggagagcctacctgg agggccTgtgcgtggagtggctccgcagatacctggagaacgggaaggagacgctgcagcgcgcggaccccccaaagaca cacgtgacccaccaccccGtctctgaccatgaggccaccctgaggtgctgggccctgggcttctaccctgcggagatcac actgacctggcagcgggatggcgaggaccaaactcaggacactgagcttgtggagaccagaccagcaggagatagaacct tccagaagtgggcagctgtggtggtgccttctggagaagagcagagatacacatgccatgtacagcatgaggggctgccg aagcccctcaccctgagatggg B*5106
(SEQ ID NO: 1553)
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccAtggatagagca ggaggggccggagtattgggaccggaacacacagatctTcaagaccaacacacagacttaccgagagaacctgcggatcg cgctcCgctactacaaccagagcgaggccgggtctcacaccctccagaggatgtacggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg B*5107
(SEQ ID NO: 1554)
gctcccactccatgaggtatttctacaccgccatgtcccggcccggccgcggggagccccgcttcatTgcagtgggctac gtggacgacacccagttcgtgaggttcgacagcgacgccgcgagtccgaggaCggagccccgggcgccatggatagagca ggaggggccggagtattgggaccggaacacacagatctCcaagaccaacacacagacttaccgagagaacctgcggatcg cgctcCgctactacaaccagagcgaggccgggtctcacacttggcagaCgatgtaTggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg B*5108
(SEQ ID NO: 1555)
atgcgggtcacggcgccccgaaccgtcctcctgctgctctgggggcagtggccctgaccgagacctgggccggctccca ctccatgaggtatttctacaccgccatgtcccggcccggccgcggggagccccgcttcattgcagtgggctacgtggacg acacccagttcgtgaggttcgacagcgacgccgcgagtccgaggacggagccccgggcgccatggatagagcaggagggg -continued ccggagtattgggaccggaacacacagatcttcaagaccaacacacagacttaccgagagaacctgcggatcgcgctccg ctactacaaccagagcgaggccgggtctcacacttggcagacgatgtatggctgcgacgtggggccggacgggcgcctcc tccgcgggcataaccagtacgcctacgacggcaaagattacatcgccctgaacgaggacctgagctcctggaccgcggcg gacaccgcggctcagatcacccagcgcaagtgggaggcggcccgtgtggcggagcaggaCagagcctacctggagggcct gtgcgtggagtggctccgcagaCacctggagaacgggaaggagacgctgcagcgcgcggaccccccaaagacacacgtga cccaccacccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga B*5109                                                                (SEQ ID NO: 1556)
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccgcgggcataaccagtacgcctacgacggcaaagattacatcgccctgaacgaggacctgagctcctggac cgcggcggacaccgcggctcagatcacccagcgcaagtgggaggcggcccgtgTggcggagcagcTgagagcctacctgg agggccTgtgcgtggagtggctccgcagaCacctggagaacgggaaggagacgctgcagcgcgcgg B*5110                                                                (SEQ ID NO: 1557)
tacaccgccatgtcccggcccggccgcggggagccccgcttcattgcagtgggctacgtggacgacacccagttcgtgag gttcgacagcgacgccgcgagtccgaggacggagccccgggcgccatggatagagcaggaggggccggagtattgggacc ggaacacacagatcttcaagaccaacacacagacttaccgagagaacctgcggatcgcgctcCgctactacaaccagagc gaggccgggtctcacacttggcagaCgatgtaTggctgcgacgtggggccggacgggcgcctcctccgcgggcatAacca gtacgcctacgacggcaaggattacatcgccctgaacgaggacctgcgctcctggaccgccgcggacaccgcggctcaga tcacccagcgcaagtgggaggcggcccgtgTggcggagcagcTgagagcctacctggagggcgagtgcgtggagtggctc cgcagatacctggagaacgggaaggagacgctgcagcgcgcggaccccccaaagacacacgtgacccaccaccccGtctc tgaccatgaggccaccctgaggtgctgggccctgggcttctaccctgcggagatcacactgacctggcagcgggatggcg aggaccaaactcaggacactgagcttgtggagaccag B*5112                                                                (SEQ ID NO: 1558)
gctcccactccatgaggtatttctacaccgccatgtcccggcccggccgcggggagccccgcttcattgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgcGactacaaccagagcgaggccgggtctcacacttggcagacgatgtatggctgcgacgtggggccggacggg cgcctcctccgcgggcataaccagtacgcctacgacggcaaagattacatcgccctgaacgaggacctgagctcctggac cgcggcggacaccgcggctcagatcacccagcgcaagtgggaggcggcccgtgaggcggagcagctgagagcctacctgg agggcctgtgcgtggagtggctccgcagacacctggagaacgggaaggagacgctgcagcgcgcgg B*511301                                                              (SEQ ID NO: 1559)
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg -continued cgcctcctccgcgggcataaccagtTcgcctacgacggcaaggattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg B*511302
(SEQ ID NO: 1560)
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccgcgggcataaccagtTcgcctacgacggcaaAgattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg B*5114
(SEQ ID NO: 1561)
gctcccactccatgaggtatttctacaccgccatgtcccggcccggccgcggggagccccgcttcattgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccgcgggcataaAcagtacgcctacgacggcaaagattacatcgccctgaacgaggacctgagctcctggac cgcggcggacaccgcggctcagatcacccagcgcaagtgggaggcggcccgtgaggcggagcagctgagagcctacctgg agggcctgtgcgtggagtggctccgcagacacctggagaacgggaaggagacgctgcagcgcgcgg B*5115
(SEQ ID NO: 1562)
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggaTcg cgctcCgctactacaaccagagcgaggccgggtctcacacttggcagaCgatgtaTggctgcgacCtggggccggacggg cgcctcctccgcgggcataaccagttAgcctacgacggcaaggattacatcgccctgaacgaggacctgagctcctggac cgcggcggacaccgcggctcagatcacccagcgcaagtgggaggcggcccgtgTggcggagcagcTgagagcctacctgg agggccTgtgcgtggagtggctccgcagatacctggagaacgggaaggagacgctgcagcgcgcGg B*5116
(SEQ ID NO: 1563)
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccAtggatagagca ggaggggccggagtattgggaccggaacacacagatcTcaagaccaacacacagacttaccgagagaacctgcggatcg cgctcCgctactacaaccagagcgaggccgggtctcacacttggcagaCgatgtaTggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgaggcggagcagcTgagagcctacctgg agggcgagtgcgtggagtggctccgcagaCacctggagaacgggaaggagacgctgcagcgcgcgg B*5117
(SEQ ID NO: 1564)
gctcccactccatgaggtatttctacaccgccatgtcccggcccggccgcggggagccccgcttcattgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg -continued cgtctcctccgcggTtataaccagtacgcctacgacggcaaagattacatcgccctgaacgaggacctgagctcctggac cgcggcggacaccgcggctcagatcacccagcgcaagtgggaggcggcccgtgaggcggagcagctgagagcctacctgg agggcctgtgcgtggagtggctccgcagacacctggagaacgggaaggagacgctgcagcgcgcgg B*5118
(SEQ ID NO: 1565)
gctcccactccatgaggtatttctacaccgccatgtcccggcccggccgcggggagccccgcttcattgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccCcgggcataaccagtacgcctacgacggcaaagattacatcgccctgaacgaggacctgagctcctggac cgcggcggacaccgcggctcagatcacccagcgcaagtgggaggcggcccgtgaggcggagcagctgagagcctacctgg agggcctgtgcgtggagtggctccgcagacacctggagaacgggaaggagacgctgcagcgcgcgg B*5119
(SEQ ID NO: 1566)
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccgcgggcataaccagtacgcctacgacggcaaagattacatcgccctgaacgaggacctgagctcctggac cgcggcggacaccgcggctcagatcacccagcgcaagtgggaggcggcccgtgtggcggagcagctgagaAcctacctgg agggccTgtgcgtggagtggctccgcagaCacctggagaacgggaaggagacgctgcagcgcgcgg B*5120
(SEQ ID NO: 1567)
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagactgaccgagagaacctgcggatcg cgctccgctactacaaccagagcgaggccgggtctcacacttggcagacgatgtatggctgcgacgtggggccggacggg cgcctcctccgcgggcataaccagtacgcctacgacggcaaagattacatcgccctgaacgaggacctgagctcctggac cgcggcggacaccgcggctcagatcacccagcgcaagtgggaggcggcccgtgtggcggagcaggaCagagcctacctgg agggccTgtgcgtggagtggctccgcagaCacctggagaacgggaaggagacgctgcagcgcgcgg B*5121
(SEQ ID NO: 1568)
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccgcgggcataaccagtacgcctacgacggcaaAgattacatcgccctgaacgaggacctgagctcctggac cgcggcggacaccgcggctcagatcacccagcgcaagtgggaggcggcccgtgaggcggagcagctgagagcctacctgg agggcaCgtgcgtggagtggctccgcagaCacctggagaacgggaaggagacgctgcagcgcgcgg B*5122
(SEQ ID NO: 1569)
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatctGcaagaccaacacacagacttaccgagagaacctgcggatcg cgctcCgctactacaaccagagcgaggccgggtctcacacttggcagaCgatgtaTggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*5123

(SEQ ID NO: 1570)

gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccgcgggcataaccagtacgcctacgacggcaaagattacatcgccctgaacgaggacctgagctcctggac cgcggcggacaccgcggctcagatcacccagcgcaagtgggaggcggcccgtgaggcggagcagcTgagagcctacctgg agggcctgtgcgtggagtCgctccgcagatacctggagaacgggaaggagacgctgcagcgcgcgg

B*5124

(SEQ ID NO: 1571)

gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccAtggatagagca ggaggggccggagtattgggaccggaacacacagatctTcaagaccaacacacagacttaccgagagaacctgcggatcg cgctcCgctactacaaccagagcgaggccgggtctcacacttggcagaCgatgtaTggctgcgacgtggggccggacggg cgcctcctccgcgggcatAaccagtacgcctacgacggcaaagattacatcgccctgaacgaggacctgcgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*5126

(SEQ ID NO: 1572)

gctcccactccatgaggtatttctacaccgccatgtcccggcccggccgcggggagccccgcttcattgcagtgggctac gtggacgacacccagttcgtgaggttcgacagcgacgccgcgagtccgaggacggagAcccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccgcgggcataaccagtacgcctacgacggcaaagattacatcgccctgaacgaggacctgagctcctggac cgcggcggacaccgcggctcagatcacccagcgcaagtgggaggcggcccgtgaggcggagcagctgagagcctacctgg agggcctgtgcgtggagtggctccgcagacacctggagaacgggaaggagacgctgcagcgcgcgg

B*5128

(SEQ ID NO: 1573)

gctcccactccatgaggtatttctacaccgccatgtcccggcccggccgcggggagccccgcttcattgcagtgggctac gtggacgacacccagttcgtgaggttcgacagcgacgccgcgagtccgaggacggagccccgggcgccatggatagagca ggaggggcGggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccgcgggcataaccagtacgcctacgacggcaaagattacatcgccctgaacgaggacctgagctcctggac cgcggcggacaccgcggctcagatcacccagcgcaagtgggaggcggcccgtgaggcggagcagctgagagcctacctgg agggcctgtgcgtggagtggctccgcagacacctggagaacgggaaggagacgctgcagcgcgcgg

B*5129

(SEQ ID NO: 1574)

gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatctTcaagaccaacacacagacttaccgagagaacctgcggatcg cgctcCgctactacaaccagagcgaggccgggtctcacacttggcagaCgatgtatggctgcgacgtggggccggacggg cgcctcctccgcgggcataaccagtacgcctacgacggcaaagattacatcgccctgaacgaggacctgagctcctggac -continued cgcggcggacaccgcggctcagatcacccagcgcaagtgggaggcggcccgtgaggcggagcagcggagagcctacctgg agggcctgtgcgtggagtggctccgcagaCacctggagaacgggaaggagacgctgcagcgcgcggaccccccaaagaca cacgtgacccaccaccccGtctctgaccatgaggccaccctgaggtgctgggccctgggcttctaccctgcggagatcac actgacctggcagcgggatggcgaggaccaaactcaggacactgagcttgtggagaccagaccagcaggagatagaacct tccagaagtgggcagctgtggtggtgccttctggagaagagcagagatacacatgccatgtacagcatgaggggctgccg aagcccctcaccctgagatggg

B*5130

(SEQ ID NO: 1575)

gctcccactccatgaggtatttctacaccgccatgtcccggcccggccgcggggagccccgcttcattgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccgcgggcataaccagtacgcctacgacggcaaagattacatcgccctgaacgaggacctgagctcctggac cgcggcggacaccgcggctcagatcacccagcgcaagtgggaggcggcccgtgaggcggagcagctgagagcctacctgg agggcctgtgcgtggagtggctccgcagacacctggagaacgggaaggagacgctgcagcgcgcggaccccccaaagaca cacgtgacccaccaccccGtctctgaccatgaggccaccctgaggtgctgggccctgggcttctaccctgcggagatcac actgacctggcagcgggatggcgaggaccaaactcaggacactgagcttgtggagaccagaccagcaggagatGgaacct tccagaagtgggcagctgtggtggtgccttctggagaagagcagagatacacatgccatgtacagcatgaggggctgccg aagcccctcaccctgagatggg

B*5131

(SEQ ID NO: 1576)

gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccgcgggcataaccagtacgcctacgacggcaaAgattacatcgccctgaacgaggacctgagctcctggac cgcggcggacaccgcggctcagatcacccagcgcaagtgggaggcggcccgtgTggcggagcagcTgagagcctacctgg agggcgagtgcgtggagtggctccgcagaCacctggagaacgggaaggagacgctgcagcgcgcgg

B*5132

(SEQ ID NO: 1577)

gctcccactccatgaggtatttctacaccgccatgtcccggcccggccgcggggagccccgcttcattgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacacttggcagacgatgtatggctgcgacgtggggccggacggg cgcctcctccgcgggcataaccagtacgcctacgacggcaaagattacatcgccctgaacgaggacctgagctcctggac cgcggcggacaccgcggctcagatcacccagcgcaagtgggaggcggcccgtgaggcggagcagctgagagcctacctgg agggcctgtgcgtggagtggctccgcagacacctggagaacgggaaggagacgctgcagcgcgcggaccccccaaagaca cacgtgacccaccaccccgtctctgaccatgaggccaccctgaggtgctgggccctgggcttctaccctgcggagatcac actgacctggcagcgggatggcgaggaccaaactcaggacactgagcttgtggagaccagaccagcaggagatagaacct tccagaagtgggcagctgtggtggtgccttctggagaagagcagagatacacatgccatgtacagcatgaggggctgcTg aagcccctcaccctgagatggg

B*5133

(SEQ ID NO: 1578)

gctcccacttcatgaggtatttctacaccgccatgtcccggcccggccgcggggagccccgcttcatTgcagtgggctac gtggacgacacccagttcgtgaggttcgacagcgacgccgcgagtccgaggacggagccccgggcgccAtggatagagca -continued ggaggggccggagtattgggaccggaacacacagatctTcaagaccaacacacagacttaccgagagaacctgcggatcg cgctcCgctactacaaccagagcgaggccgggtctcacacttggcagaCgatgtaTggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*5134

(SEQ ID NO: 1579)

gctcccactccatgaggtatttctacaccgccatgtcccggcccggccgcggggagccccgcttcatTgcagtgggctac gtggacgacacccagttcgtgaggttcgacagcgacgccgcgagtccgaggacggagcccccgggcgccAtggatagagca ggaggggccggagtattgggaccggaacacacagatctTcaagaccaacacacagacttaccgagagaacctgcggatcg cgctcCgctactacaaccagagcgaggccgggtctcacacttggcagaCgatgtaTggctgcgacgtggggccggacggg cgcctcctccgcgggcataaccagtacgcctacgacggcaaAgattacatcgccctgaacgaggacctgAgctcctggac cgcggcggacacCgcggctcagatcacccagcgcaagtgggaggcggcccgtgaggcggagcagcTgagagcctacctgg agggcgagtgcgtggagtggctccgcagatacctggagaacgggaaggagacgctgcagcgcgcgg

B*520101

(SEQ ID NO: 1580)

atgcgggtcacggcgccccgaaccgtcctcctgctgctctgggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggacggagcccccgggcgccatggatagagcaggagggg ccggagtattgggaccgggagacacagatctCcaagaccaacacacagacttaccgagagaacctgcggatcgcgctcCg ctactacaaccagagcgaggccgggtctcacacttggcagaCgatgtatggctgcgacgtggggccggacgggcgcctcc tccgcgggcataaccagtacgcctacgacggcaaagattacatcgccctgaacgaggacctgagctcctggaccgcggcg gacaccgcggctcagatcacccagcgcaagtgggaggcggcccgtgaggcggagcagcTgagagcctacctggagggcct gtgcgtggagtggctccgcagaCacctggagaacgggaaggagacgctgcagcgcgcggaccccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgagggctgccgaagccccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*520102

(SEQ ID NO: 1581)

gtcctcctgctgctctgggggcagtggccctgaccgagacctgggccggctcccactccatgaggtatttctacaccgc catgtcccggcccggccgcggggagccccgcttcatTgcagtgggctacgtggacgacacccagttcgtgaggttcgaca gcgacgccgcgagtccgaggacggagcccccgggcgccatggatagagcaggaggggccggagtattgggaccgggagaca cagatctCcaagaccaacacacagacttaccgagagaacctgcggatcgcgctcCgctactacaaccagagcgaggccgg gtctcacacttggcagaCgatgtatggctgcgacgtggggccggacgggcgcctcctccgcgggcataaccagtacgcct acgacggcaaagattacatcgccctgaacgaggacctgagctcctggaccgcggcggacaccgcggctcagatcacccag cgcaagtgggaggcggcccgtgaggcggagcagcTgagagcctacctggagggcctgtgcgtggagtggctccgcagaCa cctggagaacgggaaggagacgctgcagcgcgcggaccccccaaagacacacgtgacccaccaccccGtctctgaccatg aggccaccctgaggtgctgggccctgggcttctaccctgcggagatcacactgacctggcagcgggatggcgaggaccaa actcaggacactgagcttgtggagaccagaccagcaggagatagaaccttccagaagtgggcagctgtggtggtgccttc tggagaagagcagagatacacatgccatgtacagcatgagggctgccgaagcccctcaccctgagatgggagccatctt

```
cccagtccaccatccccatcgtgggcattgttgctggcctggctgtccta...gcagttgtggtcatcggagctgtggtc
gctactgtgatgtgtaggaggaagagCtcaggtgga
```

B*520103

(SEQ ID NO: 1582)
```
gctcccactccatgaggtatttctacaccgccatgtcccggcccggccgcggggagccccgcttcatcgcagtgggctac
gtggacgacacccagttcgtgaggttcgacagcgacgccgcgagtccgaggaCggagccgcgggcgccatggatagagca
ggaggggccggagtattgggacccgggaGacacagatctCcaagaccaacacacagacttaccgagagaacctgcggatcg
cgctcCgctactacaaccagagcgaggccgggtctcacacttggcagaCgatgtaTggctgcgacgtggggccggacggg
cgcctcctccgcgggcataaccagtacgcctacgacggcaaAgattacatcgccctgaacgaggacctgagctcctggac
cgcggcggacaccgcggctcagatcacccagcgcaagtgggaggcggcccgtgaggcggagcagcTgagagcctacctgg
agggccTgtgcgtggagtggctccgcagaCacctggagaacgggaaggagacgctgcagcgcgcgg
```

B*520104

(SEQ ID NO: 1583)
```
gctcccactccatgaggtatttctacaccgccatgtcccggcccggccgcggggagccccgcttcattgcagtgggctac
gtggacgacacccagttcgtgaggttcgacagcgacgccgcgagtccgaggacggagccccgggcgccatggatagagca
ggaggggccggagtattgggacccgggagacacagatctccaagaccaacacacagacttaccgagagaacTtgcggatcg
cgctccgctactacaaccagagcgaggccgggtctcacacttggcagacgatgtatggctgcgacgtggggccggacggg
cgcctcctccgcgggcataaccagtacgcctacgacggcaaagattacatcgccctgaacgaggacctgagctcctggac
cgcggcggacaccgcggctcagatcacccagcgcaagtgggaggcggcccgtgaggcggagcagctgagagcctacctgg
agggcctgtgcgtggagtggctccgcagacacctggagaacgggaaggagacgctgcagcgcgcgg
```

B*5202

(SEQ ID NO: 1584)
```
gctcccactccatgaggtatttctacaccgccatgtcccggcccggccgcggggagccccgcttcatTgcagtgggctac
gtggacgacacccagttcgtgaggttcgacagcgacgccgcgagtccgaggatggCgccccgggcgccatggatagagca
ggaggggccggagtattgggacccgggaGacacagatctCcaagaccaacacacagacttaccgagagaacctgcggatcg
cgctcCgctactacaaccagagcgaggccgggtctcacacttggcagaCgatgtaTggctgcgacgtggggccggacggg
cgcctcctccgcgggcataaccagtacgcctacgacggcaaAgattacatcgccctgaacgaggacctgAgctcctggac
cgcggcggacaccgcggctcagatcacccagcgcaagtgggaggcggcccgtgaggcggagcagcTgagagcctacctgg
agggccTgtgcgtggagtggctccgcagaCacctggagaacgggaaggagacgctgcagcgcgcgg
```

B*5203

(SEQ ID NO: 1585)
```
gctcccactccatgaggtatttctacaccgccatgtcccggcccggccgcggggagccccgcttcatTgcagtgggctac
gtggacgacacccagttcgtgaggttcgacagcgacgccgcgagtccgaggacggagccccgggcgccatggatagagca
ggaggggccggagtattgggaccgggagacacagatctCcaagaccaacacacagacttaccgagagaacctgcggatcg
cgctccgctactacaaccagagcgaggccgggtctcacacttggcagacgatgtatggctgcgacgtggggccggacggg
cgcctcctccgcgggcataaccagtacgcctacgacggcaaagattacatcgccctgaacgaggacctgagctcctggac
cgcggcggacaccgcggctcagatcacccagcgcaagtgggaggcggcccgtgTggcggagcagcTgagagcctacctgg
agggccTgtgcgtggagtggctccgcagatacctggagaacgggaaggagacgctgcagcgcgcgg
```

B*5204

(SEQ ID NO: 1586)
```
atgcgggtcacggcgccccgaaccgtcctcctgctgctctgggggcagtggcctgaccgagacctgggccggctccca
ctccatgaggtatttctacaccgccatgtcccggcccggccgcggggagccccgcttcatcgcagtgggctacgtggacg
acacccagttcgtgaggttcgacagcgacgccgcgagtcAgaggacggagccccgggcgccatggatagagcaggagggg
ccggagtattgggacccgggagacacagatctccaagaccaacacacagacttaccgagagaacctgcggatcgcgctccg
ctactacaaccagagcgaggccgggtctcacacttggcagacgatgtatggctgcgacgtggggccggacgggcgcctcc
```

-continued

```
tccgcgggcataaccagtacgcctacgacggcaaagattacatcgccctgaacgaggacctgagctcctggaccgcggcg gacaccgcggctcagatcacccagcgcaagtgggaggcggcccgtgaggcggagcagctgagagcctacctggagggcct gtgcgtggagtggctccgcagacacctggagaacgggaaggagacgctgcagcgcgcggaccccccaaagacacacgtga cccaccaccccgtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagctcag
```

B*5205 (SEQ ID NO: 1587)
```
gctcccactccatgaggtatttctacaccgccatgtcccggcccggccgcggggagccccCcttcatcgcagtgggctac gtggacgacacccagttcgtgaggttcgacagcgacgccgcgagtccgaggacggagccccgggcgccatggatagagca ggaggggccggagtattgggaccgggagacacagatctccaagaccaacacacagacttaccgagagaacctgcggatcg cgctccgctactacaaccagagcgaggccgggtctcacacttggcagacgatgtatggctgcgacgtggggccgacggg cgcctcctccgcgggcataaccagtacgcctacgacggcaaagattacatcgccctgaacgaggacctgagctcctggac cgcggcggacaccgcggctcagatcacccagcgcaagtgggaggcggcccgtgaggcggagcagctgagagcctacctgg agggcctgtgcgtggagtggctccgcagacacctggagaacgggaaggagacgctgcagcgcgcgg
```

B*5301 (SEQ ID NO: 1588)
```
atgcgggtcacggcgccccgaaccgtcctcctgctgctctgggggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggacggagccccgggcgccatggatagagcaggagggg ccggagtattgggaccggaacacacagatcttcaagaccaacAcacagacttaccgagagaacctgcggatcgcgctcCg ctactacaaccagagcgaggccgggtctcacatcAtccagaggatgtaTggctgcgacctggggcccgacgggcgcctcc tccgcgggcatgaccagtCcgcctacgacggcaaagattacatcgccctgaacgaggacctgAgctcctggaccgcggcg gacaccgcggctcagatcacccagcgcaagtgggaggcggcccgtgTggcggagcagcTgagagcctacctggagggccT gtgcgtggagtggctccgcagatacctggagaacgggaaggagacgctgcagcgcgcggaccccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga
```

B*5302 (SEQ ID NO: 1589)
```
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctcCgctactacaaccagagcgaggccgggtctcacatcatccagaggatgtatggctgcgacctggggcccgacggg cgcctcctccgcgggcatgaccagtCcgcctacgacggcaaagattacatcgccctgaacgaggacctgagctcctggac cgcggcggacaccgcggctcagatcacccagcgcaagtgggaggcggcccgtgTggcggagcagcTgagagcctacctgg agggccTgtgcgtggagtggctccgcagaCacctggagaacgggaaggagacgctgcagcgcgcgg
```

B*5303 (SEQ ID NO: 1590)
```
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca
``` ggaggggccggagtattgggaccggaacacacagatcttcaagaccaacacacagacttaccgagagGacctgcggaccc tgctccgctactacaaccagagcgaggccgggtctcacatcatccagaggatgtatggctgcgacctggggcccgacggg cgcctcctccgcgggcatgaccagtccgcctacgacggcaaggattacatcgccctgaacgaggacctgagctcctggac cgcggcggacaccgcggctcagatcacccagcgcaagtgggaggcggcccgtgtggcggagcagcTgagagcctacctgg agggccTgtgcgtggagtggctccgcagatacctggagaacgggaaggagacgctgcagcgcgcGg

B*5304

(SEQ ID NO: 1591)
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggaTcg cgctcCgctactacaaccagagcgaggccgggtctcacatcatccagaggatgtatggctgcgacctgggggccCgacggg cgcctcctccgcgggcatgaccagtTcgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgcagcgcgcGg

B*5305

(SEQ ID NO: 1592)
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacAcacagacttaccgagagagcctgcggaTcg CgctcCgctactacaaccagagcgaggccgggtctcacatcAtccagaggatgtaTggctgcgacCtggggccCgacggg cgcctcctccgcgggcatgaccagtCcgcctacgacggcaaggattacatcgccctgaacgaggacctgAgctcctggac cgcggcggacacCgcggctcagatcacccagcgcaagtgggaggcggcccgtgTggcggagcagcTgagagcctacctgg agggccTgtgcgtggagtggctccgcagatacctggagaacgggaaggagacgctgcagcgcgcGg

B*5306

(SEQ ID NO: 1593)
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacatcatccagaggatgtatggctgcgacctggggcccgacggg cgcctcctccgcgggcatgaccagtCcgcctacgacggcaaggattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*5307

(SEQ ID NO: 1594)
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagaacctgcggatcg cgctccgctactacaaccagagcgaggccgggtctcacaccatccagaggatgtCtggctgcgacgtggggccggacggg cgcctcctccgcggtataaccagttcgcctacgacggcaaggattacatcgccctgaacgaggacctgagctcctggac cgcggcggacaccgcggctcagatcacccagcgcaagtgggaggcggcccgtgtggcggagcagcTgagagcctacctgg agggccTgtgcgtggagtggctccgcagatacctggagaacgggaaggagacgctgcagcgcgcgg

B*5308

(SEQ ID NO: 1595)
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca -continued ggaggggccggagtattgggaccggaacacacagatcttcaagaccaacAcacagacttaccgagagaAcctgcggaTcg CgctcCgctactacaaccagagcgaggccgggtctcacatcAtccagaggatgtaTggctgcgacCtggggccCgacggg cgcctcctccgcgggcatgaccagtCcgcctacgacggcaaggattacatcgccctgaacgaggacctgAgctcctggac cgcggcggacacCgcggctcagatcacccagcgcaagtgggaggcggcccgtgaggcggagcagcTgagagcctacctgg agggccTgtgcgtggagtggctccgcagatacctggagaacgggaaggagacgctgCagcgcgcGg B*5309 (SEQ ID NO: 1596)
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatctccaagaccaacacacagacttaccgagagaacctgcgCaccg cgctccgctactacaaccagagcgaggccgggtctcacatcatccagaggatgtatggctgcgacctggggcccgacggg cgcctcctccgcgggcatgaccagtCcgcctacgacggcaaggattacatcgccctgaacgaggacctgagctcctggac cgcggcggacacCgcggctcagatcacccagcgcaagtgggaggcggcccgtGgcggagcagcTgagagcctacctgg agggcCTgtgcgtggagtggctccgcagatacctggagaacgggaaggagacgctgCagcgcgcGg B*5401 (SEQ ID NO: 1597)
atgcgggtcacggcaccccgaaccctcctcctgctgctctgggggccctggccctgaccgagacctgggccggctccca ctccatgaggtatttctacaccgccatgtcccggcccggccgcggggagccccgcttcatcgcagtgggctacgtggacg acacgcagttcgtgCggttcgacagcgacgccgcgagtccgagaggggagccgcgggcgccgtgggtggagcaggagggg ccggagtattgggaccggaacacacagatctacaaggcccaggcacagactgaccgagagagcctgcggaacctgcgcgg ctactacaaccagagcgaggccgggtctcacacttggcagacgatgtatggctgcgacctggggccggacgggcgcctcc tccgcgggcataaccagttagcctacgacggcaaggattacatcgccctgaacgaggacctgagctcctggaccgcggcg gacaccgcggctcagatcacccagcgcaagtgggaggcggcccgtgtggcggagcagctgagagcctacctggagggcac gtgcgtggagtggctccgcagatacctggagaacgggaaggagacgctgcagcgcgcggaccccccaaagacacacgtga cccaccacccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtcctta...gca gttgtggtcatcggagctgtggtcgctactgtgatgtgtaggaggaagagCtcaggtgga B*5402 (SEQ ID NO: 1598)
gctcccactccatgaggtatttcCacacctccgtgtcccggcccggccgcggggagccccgcttcatcgcagtgggctac gtggacgacacgcagttcgtgCggttcgacagcgacgccgcgagtccgagaggggagccgcgggcgccgtgggtggagca ggaggggccggagtattgggaccggaacacacagatctacaaggcccaggcacagactgaccgagagagcctgcggaacc tgcgcggctactacaaccagagcgaggccgggtctcacacttggcagacgatgtatggctgcgacctggggccggacggg cgcctcctccgcgggcataaccagttagcctacgacggcaaggattacatcgccctgaacgaggacctgagctcctggac cgcggcggacaccgcggctcagatcacccagcgcaagtgggaggcggcccgtgtggcggagcagctgagagcctacctgg agggcaCgtgcgtggagtggctccgcagatacctggagaacgggaaggagacgctgcagcgcgcgg B*5501 (SEQ ID NO: 1599)
atgcgggtcacggcaccccgaaccctcctcctgctgctctgggggccctggccctgaccgagacctgggccggctccca ctccatgaggtatttctacaccgccatgtcccggcccggccgcggggagccccgcttcatcgcagtgggctacgtggacg acacgcagttcgtgaggttcgacagcgacgccgcgagtccgagagaggagccgcgggcgccgtggatagagcaggagggg ccggagtattgggaccggaacacacagatctacaaggcccaggcacagactgaccgagagagcctgcggaacctgcgcgg ctactacaaccagagcgaggccgggtctcacacttggcagacgatgtatggctgcgacctggggccggacgggcgcctcc -continued tccgcgggcataaccagttAgcctacgacggcaaggattacatcgccctgaacgaggacctgagctcctggaccgcggcg gacaccgcggctcagatcacccagcgcaagtgggaggcggcccgtgaggcggagcagctgagagcctacctggagggcaC gtgcgtggagtggctccgcagatacctggagaacgggaaggagacgctgcagcgcgcggaccccccaaagacacacgtga cccaccacccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcaggtgga

B*5502 (SEQ ID NO: 1600)

atgcgggtcacggcaccccgaaccctcctcctgctgctctgggggccctggccctgaccgagacctgggccggctccca ctccatgaggtatttctacaccgccatgtcccggcccggccgcggggagccccgcttcatcgcagtgggctacgtggacg acacgcagttcgtgaggttcgacagcgacgccgcgagtccgagagaggagccgcgggcgccgtggatagagcaggagggg ccggagtattgggaccggaacacacagatctacaaggcccaggcacagactgaccgagagagcctgcggaacctgcgcgg ctactacaaccagagcgaggccgggtctcacacttggcagacgatgtatggctgcgacctggggccggacgggcgcctcc tccgcgggcataaccagttAgcctacgacggcaaggattacatcgccctgaacgaggacctgagctcctggaccgcggcg gacaccgcggctcagatcacccagcgcaagtgggaggcggcccgtgTggcggagcagctgagagcctacctggagggcaC gtgcgtggagtggctccgcagatacctggagaacgggaaggagacgctgcagcgcgcggaccccccaaagacacacgtga cccaccacccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcaggtgga

B*5503 (SEQ ID NO: 1601)

gctcccactccatgaggtatttctacaccgccatgtcccggcccggccgcggggagccccgcttcatcgcagtgggctac gtggacgacacgcagttcgtgaggttcgacagcgacgccgcgagtccgagagaggagccgcgggcgccgtggatagagca ggaggggccggagtattgggaccggaacacacagatctacaaggcccaggcacagactgaccgagTgagcctgcggaacc tgcgcggctactacaaccagagcgaggccgggtctcacacttggcagacgatgtatggctgcgacctggggccggacggg cgcctcctccgcgggcataaccagttAgcctacgacggcaaggattacatcgccctgaacgaggacctgagctcctggac cgcggcggacaccgcggctcagatcacccagcgcaagtgggaggcggcccgtgaggcggagcagctgagagcctacctgg agggcaCgtgcgtggagtggctccgcagatacctggagaacgggaaggagacgctgCagcgcgcGg

B*5504 (SEQ ID NO: 1602)

gctcccactccatgaggtatttctacaccgccAtgtcccggcccggccgcggggagccccgcttcatcGcagtgggctac gtggacgacacGcagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagcatgtacggctgcgacgtggggccggacggg cgcctcctccgcgggcatAaccagtacgcctacgacggcaaggattacatcgccctgaacgaggacctgcgctcctggac cgccgcggacacCgcggctcagatcacccagcgcaagtgggaggcggcccgtgTggcggagcagcTgagagcctacctgg agggcaCgtgcgtggagtggctccgcagatacctggagaacgggaaggaGacgctgCagcgcgcGg

B*5505

(SEQ ID NO: 1603)

atgcgggtcacggcaccccgaaccctcctcctgctgctctgggggccctggccctgaccgagacctgggccggctccca ctccatgaggtatttctacaccgccatgtcccggcccggccgcggggagccccgcttcatcgcagtgggctacgtggacg acacgcagttcgtgaggttcgacagcgacgccgcgagtccgagagaggagccgcgggcgccgtggatagagcaggagggg ccggCgtattgggaccggaacacacagatctacaaggcccaggcacagactgaccgagagagcctgcggaacctgcgcgg ctactacaaccagagcgaggccgggtctcacacttggcagacgatgtatggctgcgacctggggccggacgggcgcctcc tccgcgggcataaccagttagcctacgacggcaaggattacatcgccctgaacgaggacctgagctcctggaccgcggcg gacaccgcggctcagatcacccagcgcaagtgggaggcggcccgtgaggcggagcagctgagagcctacctggagggcac gtgcgtggagtggctccgcagatacctggagaacgggaaggagacgctgcagcgcgcggaccccccaaagacacacgtga cccaccacccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagctcaggtgga

B*5507

(SEQ ID NO: 1604)

gctcccactccatgaggtatttctacaccgccAtgtcccggcccggccgcggggagccccgcttcatcgcagtgggctac gtggacgacacgcagttcgtgaggttcgacagcgacgccgcgagtccgagagGggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacacttggcagacgatgtatggctgcgacctggggccggacggg cgcctcctccgcgggcataaccagttAgcctacgacggcaaggattacatcgccctgaacgaggacctgagctcctggac cgcggcggacaccgcggctcagatcacccagcgcaagtgggaggcggcccgtgtggcggagcagctgagagcctacctgg agggcacgtgcgtggagtggctccgcagatacctggagaacgggaaggagacgctgcagcgcgcGg

B*5508

(SEQ ID NO: 1605)

gctcccactccatgaggtatttctacaccgccatgtcccggcccggccgcggggagccccgcttcatcGcagtgggctac gtggacgacacGcagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagGatgtacggctgcgacgtggggccggacggg cgcctcctccgcgggcatAaccagtacgcctacgacggcaaggattacatcgccctgaacgaggacctgcgctcctggac cgccgcggacacCgcggctcagatcacccagcgcaagtgggaggcggcccgtgTggcggagcagcTgagagcctacctgg agggccTgtgcgtggagtggctccgcagatacctggagaacgggaaggagacgctgcagcgcgcGg

B*5509

(SEQ ID NO: 1606)

gctcccactccatgaggtatttctacaccgccAtgtcccggcccggccgcggggagccccgcttcatcGcagtgggctac gtggacgacacGcagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacacttggcagaCgatgtaTggctgcgacCtggggccggacggg cgcctcctccgcgggcataaccagttAgcctacgacggcaaggattacatcgccctgaacgaggacctgagctcctggac cgcggcggacacCgcggctcagatcacccagcgcaagtgggaggcggcccgtgaggcggagcagcggagagcctacctgg agggcgagtgcgtggagtggctccgcagatacctggagaacgggaaggagacgctgcagcgcgcGg -continued B*5510
(SEQ ID NO: 1607)
gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacacttggcagaCgatgtaTggctgcgacCtggggccggacggg cgcctcctccgcgggcataaccagttAgcctacgacggcaaggattacatcgccctgaacgaggacctgagctcctggac cgcggcggacaccgcggctcagatcacccagcgcaagtgggaggcggcccgtgTggcggagcagctgagagcctacctgg agggcaCgtgcgtggagtggctccgcagatacctggagaacgggaaggagacgctgcagcgcgcGg B*5511
(SEQ ID NO: 1608)
gctcccactccatgaggtatttctacaccgccatgtcccggcccggccgcggggagccccgcttcatcgcagtgggctac gtggacgacacgcagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacacttggcagaTgatgtatggctgcgacctggggccggacggg cgcctcctccgcgggcataaccagttagcctacgacggcaaggattacatcgccctgaacgaggacctgagctcctggac cgcggcggacaccgcggctcagatcacccagcgcaagtgggaggcggcccgtgaggcggagcagctgagagcctacctgg agggcaCgtgcgtggagtggctccgcagatacctggagaacgggaaggagacgctgcagcgcgcGg B*5512
(SEQ ID NO: 1609)
atgcgggtcacggcaccccgaaccctcctcctgctgctctgggggccctggccctgaccgagacctgggccggctccca ctccatgaggtatttctacaccgccatgtcccggcccggccgcggggagccccgcttcatcgcagtgggctacgtggacg acacgcagttcgtgaggttcgacagcgacgccgcgagtccgagagaggagccgcgggcgccgtggatagagcaggagggg ccggagtattgggaccggaacacacagatctacaaggcccaggcacagactgaccgagagaAcctgcggaacctgcgcgg ctactacaaccagagcgaggccgggtctcacacttggcagacgatgtatggctgcgacctggggccggacgggcgcctcc tccgcgggcataaccagttAgcctacgacggcaaggattacatcgccctgaacgaggacctgagctcctggaccgcggcg gacaccgcggctcagatcacccagcgcaagtgggaggcggcccgtgTggcggagcagctgagagcctacctggagggcaC gtgcgtggagtggctccgcagatacctggagaacgggaaggagacgctgcagcgcgcggacccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcaggtgga B*5601
(SEQ ID NO: 1610)
atgcgggtcacggcaccccgaaccctcctcctgctgctctgggggccctggccctgaccgagacctgggccggctccca ctccatgaggtatttctacaccgccatgtcccggcccggccgcggggagccccgcttcatcgcagtgggctacgtggacg acacgcagttcgtgaggttcgacagcgacgccgcgagtccgagagaggagccgcgggcgccgtggatagagcaggagggg ccggagtattgggaccggaacacacagatctacaaggcccaggcacagactgaccgagagagcctgcggaacctgcgcgg ctactacaaccagagcgaggccgggtctcacacttggcagacgatgtaTggctgcgacctggggccggacgggcgcctcc tccgcgggcataaccagttAgcctacgacggcaaggattacatcgccctgaacgaggacctgagctcctggaccgcggcg gacaccgcggctcagatcacccagcgcaagtgggaggcggcccgtgTggcggagcagcTgagagcctacctggagggccT gtgcgtggagtggctccgcagatacctggagaacgggaaggagacgctgcagcgcgcggacccccccaaagacacacgtga cccaccaccccatctctgaccatgaggccaccctgaggtgctgggccctgggcttctaccctgcggagatcacactgacc -continued tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcaggtgga

B*5602

(SEQ ID NO: 1611)

atgcgggtcacggcaccccgaaccctcctcctgctgctctGgggggccctggccctgaccgagacctgggccggctccca ctccatgaggtatttctacaccgccatgtcccggcccggccgcggggagcccgcttcatcgcagtgggctacgtggacg acacgcagttcgtgaggttcgacagcgacgccgcgagtccgagagaggagccgcgggcgccgtggatagagcaggaggg ccggagtattgggaccggaacacacagatctacaaggcccaggcacagactgaccgagagagcctgcggaacctgcgcgg ctactacaaccagagcgaggccgggtctcacaccctccagaggatgtacggctgcgacctggggccggacgggcgcctcc tccgcgggcataaccagttAgcctacgacggcaaggattacatcgccctgaacgaggacctgagctcctggaccgcggcg gacaccgcggctcagatcacccagcgcaagtgggaggcggcccgtgTggcggagcagcTgagagcctacctggagggccT gtgcgtggagtggctccgcagatacctggagaacgggaaggagacgctgcagcgcgcggaccccccaaagacacacgtga cccaccaccccatctctgaccatgaggccacctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcaggtgga

B*5603

(SEQ ID NO: 1612)

atgcgggtcacggcaccccgaaccCtcctcctgctgctctGgggggccctggccctgaccgagacctgggccggctccca ctccatgaggtatttctacaccgccatgtcccggcccggccgcggggagcccgcttcatcGcagtgggctacgtggacg acacccagttcgtgaggttcgacagcgacgccgcgagtccgagagaggagccgcgggcgccgtggatagagcaggaggg ccggagtattgggaccggaacacacagatctacaaggcccaggcacagactgaccgagagagcctgcggaacctgcgcgg ctactacaaccagagcgaggccgggtctcacaccctccagagGatgtacggctgcgacgtggggccggacgggcgcctcc tccgcgggcatgaccagtccgcctacgacggcaaggattacatcgccctgaacgaggacctgagctcctggaccgcggcg gacacgcggctcagatcacccagcgcaagtgggaggcggcccgtgaggcggagcagTgagagcctacctggagggcct gtgcgtggagtggctccgcagatacctggagaacgggaaggagacgctgcagcgcgcggaccccccaaagacacatgtga cccaccaccccatctctgaccatgaggccacctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*5604

(SEQ ID NO: 1613)

gctcccactccatgaggtatttctacaccgccatgtcccggcccggccgcggggagcccgcttcatcGcagtgggctac gtggacgacacGcagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagaggatgtacggctgcgacgtggggccggacggg cgcctcctccgcgggcataaccagttAgcctacgacggcaaggattacatcgccctgaacgaggacctgagctcctggac cgcggcggacaccgcggctcagatcacccagcgcaagtgggaggcggcccgtgTggcggagcagcTgagagcctacctgg agggccTgtgcgtggagtggctccgcagatacctggagaacgggaaggagacgctgcagcgcgcgGg

B*5605

(SEQ ID NO: 1614)
gctcccactccatgaggtatttctacaccgccatgtcccggcccggccgcggggagccccgcttcatTgcagtgggctac gtggacgacacGcagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacacttggcagaCgatgtaTggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*5606

(SEQ ID NO: 1615)
gctcccactccatgaggtatttctacaccgccatgtcccggcccggccgcggggagccccgcttcatTgcagtgggctac gtggacgacacccagttcgtgaggttcgacagcgacgccgcgagtccgaggaCggagcccgggcgccAtggatagagca ggaggggccggagtattgggaccggaacacacagatctacaaggcccaggcacagactgaccgagagagcctgcggaacc tgcgcggctactacaaccagagcgaggccgggtctcacacttggcagaCgatgtaTggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*5607

(SEQ ID NO: 1616)
gctcccactccatgaggtatttctacaccgccatgtcccggcccggccgcggggagccccgcttcatcgcagtgggctac gtggacgacacGcagttcgtgaggttcgacagcgacgccgcgagtccgagagaggagccgcgggcgccgtggatagagca ggaggggccggagtattgggaccggaacacacagatctacaaggcccaggcacagactgaccgagagaacctgcgcaCcg cgctcCgctactacaaccagagcgaggccgggtctcacacttggcagaCgatgtaTggctgcgacCtggggccggacggg cgcctcctccgcgggcataaccagttAgcctacgacggcaaggattacatcgccctgaacgaggacctgagctcctggac cgcggcggacaccgcggctcagatcacccagcgcaagtgggaggcggcccgtgTggcggagcagcTgagagcctacctgg agggccTgtgcgtggagtggctccgcagatacctggagaacgggaaggagacgctgcagcgcgcGg

B*5608

(SEQ ID NO: 1617)
gctcccactccatgaggtatttctacaccgccatgtcccggcccggccgcggggagccccgcttcatcgcagtgggctac gtggacgacacgcagttcgtgaggttcgacagcgacgccgcgagtccgagagaggagccgcgggcgccgtggatagagca ggaggggccggagtattgggaccgggagacacagaagtacaaggGccaggcacagactgaccgagagagcctgcggaacc tgcgcggctactacaaccagagcgaggccgggtctcacacttggcagacgatgtatggctgcgacctggggccggacggg cgcctcctccgcgggcataaccagttagcctacgacggcaaggattacatcgccctgaacgaggacctgagctcctggac cgcggcggacaccgcggctcagatcacccagcgcaagtgggaggcggcccgtgtggcggagcagcTgagagcctacctgg agggccTgtgcgtggagtggctccgcagatacctggagaacgggaaggagacgctgcagcgcgcGg

B*5609

(SEQ ID NO: 1618)
gctcccactccatgaggtatttctacaccgccatgtcccggcccggccgcggggagccccgcttcatcGcagtgggctac gtggacgacacGcagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacatcAtccagaggatgtaTggctgcgacCtggggccCgacggg cgcctcctccgcgggcatgaccagtCcgcctacgacggcaaggattacatcgccctgaacgaggacctgAgctcctggac cgcggcggacaccgcggctcagatcacccagcgcaagtgggaggcggcccgtgTggcggagcagcTgagagcctacctgg agggccTgtgcgtggagtggctccgcagatacctggagaacgggaaggagacgctgCagcgcgcGg -continued

B*5610

(SEQ ID NO: 1619)

gctcccactccatgaggtatttctacaccgccAtgtcccggcccggccgcggggagccccgcttcatcGcagtgggctac gtggacgacacGcagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagaggatgtacggctgcgacCtggggccggacggg cgcctcctccgcgggcataaccagttAgcctacgacggcaaggattacatcgccctgaacgaggacctgagctcctggac cgcggcggacaccgcggctcagatcacccagcgcaagtgggaggcggcccgtgTggcggagcagctgagagcctacctgg agggcaCgtgcgtggagtggctccgcagatacctggagaacgggaaggagacgctgcagcgcgcGg

B*5611

(SEQ ID NO: 1620)

atgcgggtcacggcaccccgaaccCtcctcctgctgctctggggggccctggccctgaccgagacctgggccggctccca ctccatgaggtatttctacaccgccatgtcccggcccggccgcggggagccccgcttcatcgcagtgggctacgtggacg acacgcagttcgtgaggttcgacagcgacgccgcgagtccgagagaggagccgcgggcgccgtggatagagcaggagggg ccggagtattgggaccggaacacacagatctacaaggcccaggcacagactgaccgagagagcctgcggaacctgcgcgg ctactacaaccagagcgaggccgggtctcacatcatccagaggatgtatggctgcgacctggggccCgacgggcgcctcc tccgcgggcatgaccagtTcgcctacgacggcaaggattacatcgccctgaacgaggacctgagctcctggaccgcggcg gacacCgcggctcagatcacccagcgcaagtgggaggcggcccgtgTggcggagcagcTgagagcctacctggagggccT gtgcgtggagtggctccgcagatacctggagaacgggaaggagacgctgcagcgcgcggaccccccaaagacacacgtga cccaccaccccatctctgaccatgaggccaccctgaggtgctgggccctgggCttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatggg

B*570101

(SEQ ID NO: 1621)

atgcgggtcacggcaccccgaaccgtcctcctgctgctctggggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgcccgggcgccatggatagagcaggagggg ccggagtattgggacggggagacacggaacatgaaggcctccgcgcagacttaccgagagaacctgcggatcgcgctccg ctactacaaccagagcgaggccgggtctcacatcatccaggTgatgtatggctgcgacgtggggccggacgggcgcctcc tccgcgggcatgaccagtCcgcctacgacggcaaggattacatcgccctgaacgaggacctgagctcctggaccgcggcg gacacgcggctcagatcacccagcgcaagtgggaggcggcccgtgtggcggagcagcTgagagcctacctggagggcct gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccaaagcccc tcaccctgagatgggagccatcttcccaAtccaccgtccccatcgtgggcattgttgctggcctggctgtccta...gca gttgtggtcatcggagctgtggtcgctgctgtgatgtgtaggaggaagagctcaggtgga

B*570102

(SEQ ID NO: 1622)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgcccgggcgccatggatagagca ggaggggccggagtattgggacggggagacacggaacatgaaggcctccgcgcagacttaccgagagaacctgcggatcg cgctccgctactacaaccagagcgaggccgggtctcacatcatccaggtgatgtatggctgcgacgtggggccggacggg cgcctcctccgcgggcatgaccagtcTgcctacgacggcaaggattacatcgccctgaacgaggacctgagctcctggac -continued cgcggcggacacggcggctcagatcacccagcgcaagtgggaggcggcccgtgtggcggagcagctgagagcctacctgg agggcctgtgcgtggagtggctccgcagatacctggagaacgggaaggagacgctgcagcgcgcgg

B*5702

(SEQ ID NO: 1623)

atgcgggtcacggcaccccgaaccgtcctcctgctgctctgggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgccccgggcgccatggatagagcaggagggg ccggagtattgggacggggagacacggaacatgaaggcctccgcgcagacttaccgagagaacctgcgggatcgcgctccg ctactacaaccagagcgaggccgggtctcacatcatccaggtgatgtatggctgcgacgtggggccggacgggcgcctcc tccgcgggcatAaccagtacgcctacgacggcaaggattacatcgccctgaacgaggacctgagctcctggaccgcggcg gacacggcggctcagatcacccagcgcaagtgggaggcggcccgtgtggcggagcagcggagagcctacctggagggcct gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccaaagcccc tcaccctgagatgggagccatcttcccaAtccaccgtccccatcgtgggcattgttgctggcctggctgtccta...gca gttgtggtcatcggagctgtggtcgctgctgtgatgtgtaggaggaagagctcaggtgga

B*570301

(SEQ ID NO: 1624)

atgcgggtcacggcaccccgaaccgtcctcctgctgctctgggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgccccgggcgccatggatagagcaggagggg ccggagtattgggacggggagacacggaacatgaaggcctccgcgcagacttaccgagagaacctgcgggatcgcgctccg ctactacaaccagagcgaggccgggtctcacatcatccaggtgatgtatggctgcgacgtggggccggacgggcgcctcc tccgcgggcatAaccagtacgcctacgacggcaaggattacatcgccctgaacgaggacctgagctcctggaccgcggcg gacacggcggctcagatcacccagcgcaagtgggaggcggcccgtgtggcggagcagcTgagagcctacctggagggcct gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccaaagcccc tcaccctgagatgggagccatcttcccaAtccaccgtccccatcgtgggcattgttgctggcctggctgtccta...gca gttgtggtcatcggagctgtggtcgctgctgtgatgtgtaggaggaagagctcaggtgga

B*570302

(SEQ ID NO: 1625)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggagggccggagtattgggacggggagacacggaacatgaaggcctccgcgcagacttaccgagagaacctgcgggatcg cgctccgctactacaaccagagcgaggccgggtctcacatcatccaggtgatgtatggctgcgacgtggggccggacggg cgcctcctccgcgggcataaccagtacgcctacgacggcaaggattacatcgccctgaacgaggacctgagctcctggac cgcggcggacacAgcggctcagatcacccagcgcaagtgggaggcggcccgtgtggcggagcagctgagagcctacctgg agggcctgtgcgtggagtggctccgcagatacctggagaacgggaaggagacgctgcagcgcgcggaccccccaaagaca catgtgacccaccaccccatctctgaccatgaggccaccctgaggtgctgggccctgggcttctaccctgcggagatcac actgacctggcagcgggatggcgaggaccaaactcaggacaccgagcttgtggagaccagaccagcaggagatagaacct -continued tccagaagtgggcagctgtggtggtgccttctggagaagagcagagatacacatgccatgtgcagcatgaggggctgcca aagcccctcaccctgagatggg

B*5704

(SEQ ID NO: 1626)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggacggggagacacggaacatgaaggcctccgcgcagacttaccgagagaacctgcggatcg cgctccgctactacaaccagagcgaggccgggtctcacatcatccagGtgatgtatggctgcgacgtggggccggacggg cgcctcctccgcgggtatgaccagGacgcctacgacggcaaggattacatcgccctgaacgaggacctgagctcctggac cgcggcggacacggcggctcagatcacccagcgcaagtgggaggcggcccgtgTggcggagcagcggagagcctacctgg agggcctgtgcgtggagtggctccgcagatacctggagaacgggaaggagacgctgcagcgcgcGg

B*5705

(SEQ ID NO: 1627)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggacGgggagacacggaacatgaaggcctccgcgcagacttaccgagagaacctgcggatcg cgctccgctactacaaccagagcgaggccgggtctcacatcatccagaggatgtatggctgcgacctggggcccgacggg cgcctcctccgcgggTatAaccagtacgcctacgacggcaaggattacatcgccctgaacgaggacctgagctcctggac cgcggcggacacggcggctcagatcacccagcgcaagtgggaggcggcccgtgTggcggagcagcggagagcctacctgg agggccTgtgcgtggagtggctccgcagatacctggagaacgggaaggagacgctgcagcgcgcgg

B*5706

(SEQ ID NO: 1628)

atgcgggtcacggcaccccgaaccgtcctcctgctgctctgggggcagtggccctgaccgagacctgggccggctccca ctccatgaggtatttctacaccgccatgtcccggcccggccgcggggagccccgcttcatcgcagtgggctacgtggacg acacccagttcgtgaggttcgacagcgacgccgcgagtccgaggatggcgccccgggcgccatggatagagcaggagggg ccggagtattgggacggggagacacggaacatgaaggcctccgcgcagacttaccgagagaacctgcggatcgcgctccg ctactacaaccagagcgaggccgggtctcacatcatccaggtgatgtatggctgcgacgtggggccggacgggcgcctcc tccgcgggcatgaccagtccgcctacgacggcaaggattacatcgccctgaacgaggacctgagctcctggaccgcggcg gacacggcggctcagatcaTccagcgcaagtgggaggcggcccgtgtggcggagcagctgagagcctacctggagggcct gtgcgtggagtggctccgcagatacctggagaacgggaaggagacgctgcagcgcgcggacccccccaaagacacatgtga cccaccacccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccaaagcccc tcaccctgagatgggagccatcttcccaatccaccgtccccatcgtgggcattgttgctggcctggctgtccta...gca gttgtggtcatcggagctgtggtcgctgctgtgatgtgtaggaggaagagctcaggtgga

B*5707

(SEQ ID NO: 1629)

gctcccactccatgaggtatttctacaccgccatgtcccggcccggccgcggggagccccgcttcatcgcagtgggctac gtggacgacacccagttcgtgaggttcgacagcgacgccgcgagtccgaggatggcgccccgggcgccatggatagagca ggaggggccggagtattgggacggggagacacggaacatgaaggcctccgcgcagacttaccgagagaacctgcggatcg cgctccgctactacaaccagagcgaggccgggtctcacatcatccagGtgatgtatggctgcgacgtggggccggacggg cgcctcctccgcgggcataaccagtacgcctacgacggcaaggattacatcgccctgaacgaggacctgagctcctggac cgcggcggacacggcggctcagatcacccagcgcaagtgggaggcggcccgtgtggcggagcagctgagagcctacctgg agggcctgtgcgtggagtggCgctccgcagatacctggagaacgggaaggagacgctgcagcgcgcGg -continued

B*5708

(SEQ ID NO: 1630)
gctcccactccatgaggtatttctacaccgccatgtcccggcccggccgcggggagccccgcttcatcgcagtgggctac
gtggacgacacccagttcgtgaggttcgacagcgacgccgcgagtccgaggatggcgccccgggcgccatggatagagca
ggaggggccggagtattgggacggggagacacggaacatgaaggcctccgcgcagacttaccgagagaacctgcggatcg
cgctccCctactacaaccagagcgaggcccgggtctcacatcatccaggtgatgtatggctgcgacgtggggccggacggg
cgcctcctccgcgggcatgaccagtccgcctacgacggcaaggattacatcgccctgaacgaggacctgagctcctggac
cgcggcggacacggcggctcagatcacccagcgcaagtgggaggcggcccgtgtggcggagcagctgagagcctacctgg
agggcctgtgcgtggagtggctccgcagatacctggagaacgggaaggagacgctgcagcgcgcgg

B*5709

(SEQ ID NO: 1631)
gctcccactccatgaggtatttctacaccgccatgtcccggcccggccgcggggagccccgcttcatcgcagtgggctac
gtggacgacacccagttcgtgaggttcgacagcgacgccgcgagtccgaggatggcgccccgggcgccatggatagagca
ggaggggccggagtattgggacggggagacacggaacatgaaggcctccgcgcagacttaccgagagaacctgcggatcg
cgctccgctactacaaccagagcgaggcccgggtctcacatcatccagGtgatgtatggctgcgacgtggggccggacggg
cgcctcctccgcgggcataaccagtacgcctacgacggcaaggattacatcgccctgaacgaggacctgagctcctggac
cgcggcggacacggcggctcagatcacccagcgcaagtgggaggcggcccgtgaggcggagcaggaCagagcctacctgg
agggcctgtgcgtggagtggctccgcagatacctggagaacgggaaggagacgctgcagcgcgcGg

B*5801

(SEQ ID NO: 1632)
atgcgggtcacggcgccccgaaccgtcctcctgctgctctgggggcagtggcccctgaccgagacctgggccggctccca
ctccatgaggtatttctacaccgccatgtcccggcccggccgcggggagccccgcttcatcgcagtgggctacgtggacg
acacccagttcgtgaggttcgacagcgacgccgcgagtccgaggacggagccccgggcgccatggatagagcaggagggg
ccggagtattgggacGgggagacacggaacatgaaggcctccgcgcagacttaccgagagaacctgcggatcgcgctccg
ctactacaaccagagcgaggcccgggtctcacatcAtccagaggatgtatggctgcgacctggggcccgacgggcgcctcc
tccgcgggcatgaccagtccgcctacgacggcaaggattacatcgccctgaacgaggacctgagctcctggaccgcggcg
gacaccgcggctcagatcacccagcgcaagtgggaggcggcccgtgtggcggagcagctgagagcctacctggagggcct
gtgcgtggagtggctccgcagatacctggagaacgggaaggagacgctgcagcgcgcggaccccccaaagacacacgtga
cccaccaccccgtctctgaccatgaggccaccctgaggtgctgggccctgggcttctaccctgcggagatcacactgacc
tggcagcgggatggcgaggaccaaaactcaggacactgagcttgtggagaccagaccagcaggagatagaaccttccagaa
gtgggcagctgtggtggtgccttctggagaagagcagagatacacatgccatgtacagcatgaggggctgccgaagcccc
tcaccctgagatgggagccatcttcccagtccaccatccccatcgtgggcattgttgctggcctggctgtccta...gca
gttgtggtcatcggagctgtggtcgctActgtgatgtgtaggaggaagagCtcaggtgga

B*5802

(SEQ ID NO: 1633)
atgcgggtcacggcgccccgaaccgtcctcctgctgctctgggggcagtggcccctgaccgagacctgggccggctccca
ctccatgaggtatttctacaccgccatgtcccggcccggccgcggggagccccgcttcatcgcagtgggctacgtggacg
acacccagttcgtgaggttcgacagcgacgccgcgagtccgaggacggagccccgggcgccatggatagagcaggagggg
ccggagtattgggacggggagacacggaacatgaaggcctccgcgcagacttaccgagagaacctgcggatcgcgctccg
ctactacaaccagagcgaggcccgggtctcacaccctccagTggatgtatggctgcgacctggggcccgacgggcgcctcc
tccgcgggcatgaccagtccgcctacgacggcaaggattacatcgccctgaacgaggacctgagctcctggaccgcggcg
gacaccgcggctcagatcacccagcgcaagtgggaggcggcccgtgtggcggagcagctgagagcctacctggagggcct
gtgcgtggagtggctccgcagatacctggagaacgggaaggagacgctgcagcgcgcggaccccccaaagacacacgtga
cccaccaccccgtctctgaccatgaggccaccctgaggtgctgggccctgggcttctaccctgcggagatcacactgacc -continued tggcagcgggatggcgaggaccaaactcaggacactgagcttgtggagaccagaccagcaggagatagaaccttccagaa
gtgggcagctgtggtggtgccttctggagaagagcagagatacacatgccatgtacagcatgaggggctgccgaagcccc
tcaccctgagatgggagccatcttcccagtccaccatccccatcgtgggcattgttgctggcctggctgtccta...gca
gttgtggtcatcggagctgtggtcgctactgtgatgtgtaggaggaagagCtcaggtgga

B*5804

(SEQ ID NO: 1634)

atgcgggtcacggcgccccgaaccgtcctcctgctgctctgggggggcagtggccctgaccgagacctgggccggctccca
ctccatgaggtatttctacaccgccatgtcccggcccggccgcggggagcccogcttcatcgcagtgggctacgtggacg
acacccagttcgtgaggttcgacagcgacgccgcgagtccgaggacggagccccgggcgccatggatagagcaggagggg
ccggagtattgggacgAggagacacggaacatgaaggcctccgcgcagacttaccgagagaacctgcggatcgcgctccg
ctactacaaccagagcgaggccgggtctcacatcatccagaggatgtatggctgcgacctggggcccgacgggcgcctcc
tccgcgggcatgaccagtccgcctacgacggcaaggattacatcgccctgaacgaggacctgagctcctggaccgcggcg
gacaccgcggctcagatcacccagcgcaagtgggaggcggcccgtgtggcggagcagctgagagcctacctggagggcct
gtgcgtggagtggctccgcagatacctggagaacgggaaggagacgctgcagcgcgcgg

B*5805

(SEQ ID NO: 1635)

gctcccactccatgaggtatttctacaccgccatgtcccggcccggccgcggggagcccogcttcatcgcagtgggctac
gtggacgacacccagttcgtgaggttcgacagcgacgccgcgagtccgaggacggagccccgggcgccatggatagagca
ggaggggccggagtattgggacggggagacacggaacatgaaggcctccgcgcagacttaccgagagaacctgcggatcg
cgctccgctactacaaccagagcgaggccgggtctcacatcatccagaggatgtatggctgcgacctggggcccgacggg
cgcctcctccgcgggcatgaccagtccgcctacgacggcaaggattacatcgccctgaacgaggacctgagctcctggac
cgcggcggacaccgcggctcagatcacccagcgcaagttggaggcggcccgtgCggcggagcagctgagagcctacctgg
agggcacgtgcgtggagtggctccgcagatacctggagaacgggaaggagacgctgcagcgcgcgg

B*5806

(SEQ ID NO: 1636)

gctcccactccatgaggtatttctacaccgccatgtcccggcccggccgcggggagcccogcttcatcgcagtgggctac
gtggacgacacccagttcgtgaggttcgacagcgacgccgcgagtccgaggacggagccccgggcgccatggatagagca
ggaggggccggagtattgggacggggagacacggaacatgaaggcctccgcgcagacttaccgagagaacctgcggatcg
cgctccgctactacaaccagagcgaggccgggtctcacaccctccagTggatgtatggctgcgacctggggcccgacggg
cgcctcctccgcgggcatgaccagtccgcctacgacggcaaggattacatcgccctgaacgaggacctgagctcctggac
cgcggcggacaccgcggctcagatcacccagcgcaagtgggaggcggcccgtgaggcggagcagctgagagcctacctgg
agggccTgtgcgtggagtggctccgcagatacctggagaacgggaaggagacgctgcagcgcgcgg

B*5807

(SEQ ID NO: 1637)

gctcccactccatgaggtatttctacaccgccatgtcccggcccggccgcggggagcccogcttcatcgcagtgggctac
gtggacgacacccagttcgtgaggttcgacagcgacgccgcgagtccgaggacggagccccgggcgccatggatagagca
ggaggggccggagtattgggacggggagacacggaacatgaaggcctccgcgcagacttaccgagagaacctgcggatcg
cgctccgctactacaaccagagcgaggccgggtctcacaccctccagTggatgtatggctgcgacctggggcccgacggg
cgcctcctccgcgggcatgaccagtccgcctacgacggcaaggattacatcgccctgaacgaggacctgagctcctggac
cgcggcggacaccgcggctcagatcacccagcgcaagtgggaggcggcccgtgtggcggagcagctgagagcctacctgg
agggcctgtgcgtggagtCgctccgcagatacctggagaacgggaaggagacgctgcagcgcgcgg

B*5901

(SEQ ID NO: 1638)

atgcgggtcacggcaccccgaaccctcctcctgctgctctggggggccctggccctgaccgagacctgggccggctccca
ctccatgaggtatttctacaccgccatgtcccggcccggccgcggggagcccogcttcatcgcagtgggctacgtggacg
acacgcagttcgtgaggttcgacagcgacgccgcgagtccgagagaggagccgcgggcgccgtggatagagcaggagggg -continued ccggagtattgggaccggaacacacagatcttcaagaccaacacacagacttaccgagagaacctgcggatcgcgctcCg ctactacaaccagagcgaggccgggtctcacacttggcagacgatgtatggctgcgacctggggccggacgggcgcctcc tccgcgggcataaccagttAgcctacgacggcaaggattacatcgccctgaacgaggacctgagctcctggaccgcggcg gacaccgcggctcagatcacccagcgcaagtgggaggcggcccgtgTggcggagcagctgagagcctacctggagggcaC gtgcgtggagtggctccgcagatacctggagaacgggaaggagacgctgcagcgcgcggaccccccaaagacacacgtga cccaccaccccatctctgaccatgaggccaccctgaggtgctgggccctgggcttctaccctgcggagatcacactgacc tggcagcgggatggcgaggaccaaactcaggacactgagcttgtggagaccagaccagcaggagataGaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctActgtgatgtgtaggaggaagagCtcaggtgga

B*670101

(SEQ ID NO: 1639)

atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggaAtattgggaccggaacacacagatctacaaggcccaggcacagactgaccgagagagcctgcggaacctgcgcgg ctactacaaccagagcgaggccgggtctcacaccctccagagGatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagcTgagaAcctacctggagggcac gtgcgtggagtggctccgcagatacctggagaacgggaaggagacgctgcagcgcgcggaccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagaCagaaccttccagaa gtgggcagctgtggtggtgccttctggagaagagcagagatacacatgccatgtacagcatgaggggctgccgaagcccc tcaccctgagatgggagccAtcttcccagtccaccgtccccatcgtgggcattgttgctggcctggctgtccta...gca gttgtggtcatcggagctgtggtcgctgctgtgatgtgtaggaggaagagttcaggtgga

B*670102

(SEQ ID NO: 1640)

gctcccactccatgaggtatttctacacctccgtgtcccggcccggccgcggggagccccgcttcatctcagtgggctac gtggacgacacgcagttcgtgaggttcgacagcgacgccgcgagtccgagagaggagccgcgggcgccgtggatagagca ggaggggccggagtattgggaccggaacacacagatctacaaggcccaggcacagactgaccgagagagcctgcggaacc tgcgcggctactacaaccagagcgaggccgggtctcacaccctccagagGatgtacggctgcgacgtggggccggacggg cgcctcctccgcgggcatAaccagtTcgcctacgacggcaaggattacatcgccctgaacgaggacctgagctcctggac cgcggcggacaccgcggctcagatcacccagcgcaagtgggaggcggcccgtgTggcggagcagcTgagaAcctacctgg agggcaCgtgcgtggagtggctccgcagatacctggagaacgggaaggagacgctgCagcg

B*6702

(SEQ ID NO: 1641)

atgctggtcatggcgccccgaaccgtcctcctgctgctctcggcggccctggccctgaccgagacctgggccggctccca ctccatgaggtatttctacacctccgtgtcccggcccggccgcggggagccccgcttcatctcagtgggctacgtggacg acacgcagttcgtgaggttcgacagcgacgccgcgagtccAagaggggagccgcgggcgccgtgggtggagcaggagggg ccggagtattgggaccgggagacacagaagtacaagcgccaggcacaggctgaccgagtgagcctgcggaacctgcgcgg ctactacaaccagagcgaggccgggtctcacaccctccagaggatgtacggctgcgacgtggggccggacgggcgcctcc tccgcgggcataaccagttcgcctacgacggcaaggattacatcgccctgaacgaggacctgagctcctggaccgcggcg gacaccgcggctcagatcacccagcgcaagtgggaggcggcccgtgtggcggagcagctgagaacctacctggagggcac -continued gtgcgtggagtggctccgcagatacctggagaacgggaaggagacgctgcagcgcgcggaccccccaaagacacatgtga cccaccacccatctctgaccatgaggccaccctgaggtgctgggccctgggcttctaccctgcggagatcacactgacc tggcagcgggatggcgaggaccaaactcaggacaccgagcttgtggagaccagaccagcaggagacagaaccttccagaa gtgggcagctgtggtggtgccttctggagaagagcagagatacacatgccatgtacagcatgaggggctgccgaagcccc tcaccctgagatgggagccatcttcccagtccaccgtccccatcgtgggcattgttgctggcctggctgtccta...gca gttgtggtcatcggagctgtggtcgctgctgtgatgtgtaggaggaagagttcaggtgga

B*7301 (SEQ ID NO: 1642)

atgctggtcatggcgccccgaaccgtcctcctgctgctctcggcggccctggccctgaccgagacctgggccggctccca ctccatgaggtatttccacacctccgtgtcccggcctggccgcggggagcccgcttcatcaccgtgggctacgtggacg acacccagttcgtgaggttcgacagcgacgccgcgagtccgagagaggagccgcgggcgccgtggatagagcaggagggg ccggagtattgggaccggaacacacagatctgcaaggccaaggcacagactgaccgagtgggcctgcggaacctgcgcgg ctactacaaccagagcgaggacgggtctcacacttggcagacgatgtatggctgcgacatggggccggacgggcgcctcc tccgcgggtataaccagttcgcctacgacggcaaggattacatcgccctgaacgaggacctgcgctcctggaccgccgcg gacacggcggctcagatcacccagcgcaagtgggaggcggcccgtgtggcggagcagctgagagcctacctggagggcga gtgcgtggagtggctccgcagacacctggagaacgggaaggagacgctgcagcgcgcggaccccccaaagacacacgtga cccaccacccatctctgaccatgaggccaccctgaggtgctgggccctgggcttctaccctgcggagatcacactgacc tggcagcgggatggcgaggaccaaactcaggacaccgagcttgtggagaccaggccagcaggagatggaaccttccagaa gtgggcagctgtggtggtgccttctggacaagaacagagatacacgtgccatgtgcagcacgaggggctgcaggagccct gcaccctgagatggaagccatcttcccagtccaccatccccatcgtgggcattgttgctggcctggctgtccttgtggtc accgtagctgtggtCgctgtggtcgctgctgtgatgtgtaggaggaagagctcaggtgga

B*7801 (SEQ ID NO: 1643)

atgcgggtcacggcgccccgaaccgtcctcctgctgctctgggggcagtggccctgaccgagacctgggccggctccca ctccatgaggtatttctacaccgccatgtcccggcccggccgcggggagcccgcttcatTgcagtgggctacgtggacg acacccagttcgtgaggttcgacagcgacgccgcgagtccgaggacggagcccgggcgccatggatagagcaggagggg ccggagtattgggaccggaacacacagatctTcaagaccaacacacagactgaccgagagagcctgcggaacctgcgcgg ctactacaaccagagcgaggccgggtctcacacttggcagaCgatgtatggctgcgacgtggggccggacgggcgcctcc tccgcgggcataaccagtacgcctacgacggcaaagattacatcgccctgaacgaggacctgagctcctggaccgcggcg gacaccgcggctcagatcacccagcgcaagtgggaggcggcccgtgaggcggagcagcTgagagcctacctggagggcct gtgcgtggagtggctccgcagaCacctggagaacgggaaggagacgctgcagcgcgcggaccccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga

B*780201 (SEQ ID NO: 1644)

atgcgggtcacggcgccccgaaccgtcctcctgctgctctgggggcagtggccctgaccgagacctgggccggctccca ctccatgaggtatttctacaccgccatgtcccggcccggccgcggggagcccgcttcatcgcagtgggctacgtggacg acacccagttcgtgaggttcgacagcgacgccgcgagtccgaggacggagcccgggcgccatggatagagcaggagggg ccggagtattgggaccggaacacacagatctTcaagaccaacacacagactTaccgagagagcctgcggaacctgcgcgg ctactacaaccagagcgaggccgggtctcacacttggcagaCgatgtatggctgcgacgtggggccggacgggcgcctcc tccgcgggcataaccagtacgcctacgacggcaaagattacatcgccctgaacgaggacctgagctcctggaccgcggcg -continued

```
gacaccgcggctcagatcacccagcgcaagtgggaggcggcccgtgaggcggagcagcTgagagcctacctggagggcct gtgcgtggagtggctccgcagaCacctggagaacgggaaggagacgctgcagcgcgcggacccccaaagacacacgtga cccaccaccccGtctctgaccatgaggccaccctgaggtgctgggccctgggcttctaccctgcggagatcacactgacc tggcagcgggatggcgaggaccaaactcaggacactgagcttgtggagaccagaccagcaggagatagaaccttccagaa gtgggcagctgtggtggtgccttctggagaagagcagagatacacatgccatgtacagcatgaggggctgccgaagcccc tcaccctgagatgggagccatcttcccagtccaccatccccatcgtgggcattgttgctggcctggctgtccta...gca gttgtggtcatcggagctgtggtcgctactgtgatgtgtaggaggaagagCtcaggtgga
```

B*780202

(SEQ ID NO: 1645)
```
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccAtggatagagca ggaggggccggagtattgggaccggaacacacagatctTcaagaccaacacacagactTaccgagagagcctgcggaacc tgcgcggctactacaaccagagcgaggccgggtctcacacttggcagaCgatgtaTggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg
```

B*7803

(SEQ ID NO: 1646)
```
gctcccactccatgaggtatttctacaccgccatgtcccggcccggccgcggggagccccgcttcatTgcagtgggctac gtggacgacacccagttcgtgaggttcgacagcgacgccgcgagtccgaggacggagccccgggcgccatggatagagca ggaggggccggagtattgggaccggaacacacagatctGcaagaccaacAcacagactgaccgagagagcctgcggaacc tgcgcggctactacaaccagagcgaggccgggtctcacacttggcagaCgatgtaTggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg
```

B*7804

(SEQ ID NO: 1647)
```
gctcccactccatgaggtatttctacaccgccatgtcccggcccggccgcggggagccccgcttcatcgcagtgggctac gtggacgacacccagttcgtgaggttcgacagcgacgccgcgagtccgaggacggagccccgggcgccatggatagagca ggaggggccggagtattgggaccggaacacacagatcttcaagaccaacacacagacttaccgagagagcctgcggaacc tgcgcggctactacaaccagagcgaggccgggtctcacacttggcagacgatgtatggctgcgacgtggggccggacggg cgcctcctccgcgggcataaccagtacgcctacgacggcaaAgattacatcgccctgaacgaggacctgAgctcctggac cgcggcggacaccgcggctcagatcacccagcgcaagtgggaggcggcccgtgTggcggagcagcTgagagcctacctgg agggccTgtgcgtggagtggctccgcagatacctggagaacgggaaggagacgctgcagcgcgcggacccccaaagaca cacgtgacccaccaccccGtctctgaccatgaggccaccctgaggtgctgggccctgggcttctaccctgcggagatcac actgacctggcagcgggatggcgaggaccaaactcaggacactgagcttgtggagaccagaccagcaggagatagaacct tccagaagtgggcagctgtggtggtgccttctggagaagagcagagatacacatgccatgtacagcatgaggggctgccg aagcccctcaccctgagatggg
```

B*7805

(SEQ ID NO: 1648)
```
gctcccactccatgaggtatttctacaccgccatgtcccggcccggccgcggggagccccgcttcatcgcagtgggctac gtggacgacacccagttcgtgaggttcgacagcgacgccgcgagtccgaggaCggagccCcgggcgccatggatagagca ggaggggccggagtattgggaccgggaGacacagatctCcaagaccaacacacagactTaccgagagagcctgcggaacc tgcgcggctactacaaccagagcgaggccgggtctcacacttggcagaCgatgtaTggctgcgacgtggggccggacggg
```

-continued cgcctcctccgcgggcataaccagtacgcctacgacggcaaAgattacatcgccctgaacgaggacctgagctcctggac cgcggcggacaccgcggctcagatcacccagcgcaagtgggaggcggcccgtgaggcggagcagcTgagagcctacctgg agggccTgtgcgtggagtggctccgcagaCacctggagaacgggaaggagacgctgcagcgcgcgg

B*8101

(SEQ ID NO: 1649)

atgctggtcatggcgccccgaaccgtcctcctgctgctctgggggcagtggccctgaccgagacctgggccggctccca ctccatgaggtatttctacaccctccgtgtcccggcccggccgcggggagccccgcttcatctcagtgggctacgtggacg acacccagttcgtgaggttcgacagcgacgccgcgagtccgagagaggagccgcgggcgccgtggatagagcaggagggg ccggagtattgggaccggaacacacagatctacaaggcccaggcacagactgaccgagagagcctgcggaacctgcgcgg ctactacaaccagagcgaggccgggtctcacaccctccagagcatgtacggctgcgacgtggggccggacgggcgcctcc tccgcgggcataaccagtacgcctacgacggcaaggattacatcgccctgaacgaggacctgcgctcctggaccgccgcg gacacggcggctcagatctcccagcgcaagttggaggcggcccgtgtggcggagcagctgagagcctacctggagggcga gtgcgtggagtggctccgcagatacctggagaacgggaaggacaagctggagcgcgctgaccccccaaagacacacgtga cccaccaccccatctctgaccatgaggccaccctgaggtgctgggccctgggtttctaccctgcggagatcacactgacc tggcagcgggatggcgaggaccaaactcaggacactgagcttgtggagaccagaccagcaggagatagaaccttccagaa gtggacagctgtggtggtgccttctggagaagagcagagatacacatgccatgtacagcatgaggggctgccgaagcccc tcacccctgagatgggagccgtcttcccagtccaccgtccccatcgtgggcattgttgctggcctggctgtccta...gca gttgtggtcatcggagctgtggtcgctgctgtgatgtgtaggaggaagagttcTggtgga

B*8201

(SEQ ID NO: 1650)

gctcccactccatgaggtatttctacaccgctatgtcccggcccggccgcggggagccccgcttcatctcagtgggctac gtggacgacacgcagttcgtgaggttcgacagcgacgccgcgagtccgagagaggagccgcgggcgccgtggatagagca ggagggccggagtattgggaccggaacacacagatctacaaggcccaggcacagactgaccgagagagcctgcggaacc tgcgcggctactacaaccagagcgaggccgggtctcacaccctccagaggatgtttggctgcgacctggggcccgacggg cgcctcctccgcgggcataaccagttagcctacgacggcaaggattacatcgccctgaacgaggacctgagctcctggac cgcggcggacaccgcggctcagatcacccagcgcaagtgggaggcggcccgtgtggcggagcaggacagagcctacctgg aggAcctgtgcgtggagtcgctccgcagatacctggagaacgggaaggagacgctgcagcgcgcgg

B*8202

(SEQ ID NO: 1651)

atgcgggtcacggcaccccgaaccctcctcctgctgctctgggggcccggccctgaccgagacctgggctggctccca ctccatgaggtatttctacaccgctatgtcccggcccggccgcggggagccccgcttcatctcagtgggctacgtggacg acacgcagttcgtgaggttcgacagcgacgccgcgagtccgagagaggagccgcgggcgccgtggatagagcaggagggg ccggagtattgggaccggaacacacagatctacaaggcccaggcacagactgaccgagagagcctgcggaacctgcgcgg ctactacaaccagagcgaggccgggtctcacaccctccagaggatgtttggctgcgacctggggcccgacgggcgcctcc tccgcgggcataaccagttagcctacgacggcaaggattacatcgccctgaacgaggacctgagctcctggaccgcggcg gacaccgcggctcagatcacccagcgcaagtgggaggcggcccgtgtggcggagcaggacagagcctacctggagggcct gtgcgtggagtcgctccgcagatacctggagaacgggaaggagacgctgcagcgcgcggacccccccaaagacacatgtga cccaccaccccatctctgaccatgaggccaccctgaggtgctgggccctgggcttctaccctgcggagatcacactgacc tggcagcgggatggcgaggaccaaactcaggacaccgagcttgtggagaccagaccagcaggagatagaaccttccagaa gtgggcagctgtggtggtgccttctggagaagagcagagatacacatgccatgtacagcatgaggggctgccgaagcccc tcacccctgagatgggagccatcttcccagtccaccatccccatcgtgggcattgttgctggcctggctgtccta...gca gttgtggtcatcggagctgtggtTgctactgtgatgtgtaggaggaagagctcaggtgga -continued

B*8301 (SEQ ID NO: 1652)

```
atgcgggtcacggcgccccgaaccctcctcctgctgctctgggggggcaGtggccctgaccgagacctgggccggctccca
ctccatgaggtatttctacaccgccAtgtcccggcccggccgcggggagccccgcttcatctcagtgggctacgtggacg
acacccagttcgtgaggttcgacagcgacgccgcgagtccgagagaggagccgcgggcgccgtggatagagcaggaggg
ccggagtattgggaccggaacacacagatctacaaggcccaggcacagactgaccgagagagcctgcggaacctgcgcgg
ctactacaaccagagcgaggccgggtctcacatcAtccagaggatgtacggctgcgacgtggggccggacgggcgcctcc
tccgcgggTatgaccagGacgcctacgacggcaaggattacatcgccctgaacgaggacctgagctcctggaccgcggcg
gacaccgcggctcagatcacccagcgcaagtgggaggcggcccgtgtggcggagcaggaCagagcctacctggagggccT
gtgcgtggagtCgctccgcagatacctggagaacgggaaggagacgctgcagcgcgcGg
```

The following Tables 5-1 to 5-9 show Probe list B1, and Tables 6-1 to 6-8 show Probe list B2. The Allele-probe list is shown in Tables 7 and 8.

TABLE 5-1

| Probe No. | Base Sequence | |
|---|---|---|
| 0 | agg tat ttc tac acc tcc G | (SEQ ID No: 638) |
| 1 | ct cac acc ctc cag agC | (SEQ ID No: 639) |
| 2 | gc ctc ctc cgc ggg C | (SEQ ID No: 640) |
| 3 | c cgc ggg cat gac cag T | (SEQ ID No: 641) |
| 4 | gt gag gcg gag cag cG | (SEQ ID No: 642) |
| 5 | t gag gcg gag cag cgG | (SEQ ID No: 643) |
| 6 | gcc tac ctg gag ggc gA | (SEQ ID No: 644) |
| 7 | ggc gag tgc gtg gag tG | (SEQ ID No: 645) |
| 8 | c ggg aag gac aag ctg G | (SEQ ID No: 646) |
| 9 | g gag tgg ctc cgc agG | (SEQ ID No: 647) |
| 10 | gc tac gtg gac gac acG | (SEQ ID No: 648) |
| 11 | a cag atc tac aag acc aac A | (SEQ ID No: 649) |
| 12 | gt gag gcg gag cag gaC | (SEQ ID No: 650) |
| 13 | c ctc ctc cgc ggg cat A | (SEQ ID No: 651) |
| 14 | cg tct tcc cag tcc acc A | (SEQ ID No: 652) |
| 15 | ct cac acc ctc cag agG | (SEQ ID No: 653) |
| 16 | ac cgg aac aca cag atc tT | (SEQ ID No: 654) |
| 17 | a cag atc ttc aag acc aac A | (SEQ ID No: 655) |
| 18 | cgc ggg cat gac cag tC | (SEQ ID No: 656) |
| 19 | c cgg aac aca cag atc tG | (SEQ ID No: 657) |
| 20 | ca cag act gac cga gag aA | (SEQ ID No: 658) |
| 21 | g gcc ggg tct cac atc A | (SEQ ID No: 659) |
| 22 | ac atc atc cag agg atg taT | (SEQ ID No: 660) |
| 23 | gg atg tat ggc tgc gac C | (SEQ ID No: 661) |
| 24 | c tgc gac ctg ggg ccC | (SEQ ID No: 662) |
| 25 | ag aca cag aag tac aag cG | (SEQ ID No: 663) |

TABLE 5-1-continued

| Probe No. | Base Sequence | |
|---|---|---|
| 26 | c aag cgc cag gca cag G | (SEQ ID No: 664) |
| 27 | gca cag gct gac cga gT | (SEQ ID No: 665) |
| 28 | gag gcc ggg tct cac aT | (SEQ ID No: 666) |
| 29 | g tct cac atc atc cag agG | (SEQ ID No: 667) |
| 30 | cgc ctc ctc cgc ggg T | (SEQ ID No: 668) |

TABLE 5-2

| Probe No. | Base Sequence | |
|---|---|---|
| 31 | c aag gcc cag gca cag G | (SEQ ID No: 669) |
| 32 | c aag acc aac aca cag act T | (SEQ ID No: 670) |
| 33 | cgc ggg tat gac cag tC | (SEQ ID No: 671) |
| 34 | gcc tac ctg gag ggc aC | (SEQ ID No: 672) |
| 35 | ctg gag aac ggg aag gaG | (SEQ ID No: 673) |
| 36 | g acg ctg gag cgc gcG | (SEQ ID No: 674) |
| 37 | gcc tac ctg gag ggc cT | (SEQ ID No: 675) |
| 38 | ggc ctg tgc gtg gag tC | (SEQ ID No: 676) |
| 39 | c ggc cgc ggg gag cT | (SEQ ID No: 677) |
| 40 | tcc tgg acc gcc gcg A | (SEQ ID No: 678) |
| 41 | cgg aac ctg cgc ggc C | (SEQ ID No: 679) |
| 42 | gcc tac ctg gag ggc C | (SEQ ID No: 680) |
| 43 | gg gag gcg gcc cgt gT | (SEQ ID No: 681) |
| 44 | gt gtg gcg gag cag gaC | (SEQ ID No: 682) |
| 45 | cgt gag gcg gag cag cT | (SEQ ID No: 683) |
| 46 | c cgg aac aca cag atc tC | (SEQ ID No: 684) |
| 47 | ca cag act tac cga gag G | (SEQ ID No: 685) |
| 48 | ctg cgg acc ctg ctc C | (SEQ ID No: 686) |
| 49 | c cgc ggg tat gac cag G | (SEQ ID No: 687) |

TABLE 5-2-continued

| Probe No. | Base Sequence | |
|---|---|---|
| 50 | cac tcc atg agg tat ttc G | (SEQ ID No: 688) |
| 51 | gg tat ttc gac acc gcc A | (SEQ ID No: 689) |
| 52 | cg aga gag gag ccg cC | (SEQ ID No: 690) |
| 53 | a gcc tac ctg gag ggc A | (SEQ ID No: 691) |
| 54 | g atg tgt agg agg aag agC | (SEQ ID No: 692) |
| 55 | ctg cgc acc gcg ctc C | (SEQ ID No: 693) |
| 56 | c cga gag aac ctg cgg aT | (SEQ ID No: 694) |
| 57 | gag aac ctg cgg atc gC | (SEQ ID No: 695) |
| 58 | ctg cgg atc gcg ctc C | (SEQ ID No: 696) |
| 59 | c acg ctg gag cgc gcG | (SEQ ID No: 697) |
| 60 | g gac cgg aac aca cag aC | (SEQ ID No: 698) |

TABLE 5-3

| Probe No. | Base Sequence | |
|---|---|---|
| 61 | c act tgg cag acg atg taT | (SEQ ID No: 699) |
| 62 | g gag tat tgg gac cgg G | (SEQ ID No: 700) |
| 63 | c cgg gac aca cag atc tT | (SEQ ID No: 701) |
| 64 | cgt gtg gcg gag cag cT | (SEQ ID No: 702) |
| 65 | cgc ggg tac cac cag G | (SEQ ID No: 703) |
| 66 | c aca cag act gac cga gT | (SEQ ID No: 704) |
| 67 | ttc aag acc aac aca cag G | (SEQ ID No: 705) |
| 68 | c cgg gag aca cag atc tC | (SEQ ID No: 706) |
| 69 | g tgc tgg gcc ctg ggC | (SEQ ID No: 707) |
| 70 | g gct cag atc acc cag cT | (SEQ ID No: 708) |
| 71 | g tct cac act tgg cag aC | (SEQ ID No: 709) |
| 72 | cgc ggg cat aac cag ttA | (SEQ ID No: 710) |
| 73 | cg atg tat ggc tgc gac C | (SEQ ID No: 711) |
| 74 | tgg gag cca tct tcc caA | (SEQ ID No: 712) |
| 75 | gag cag ctg aga gcc tG | (SEQ ID No: 713) |
| 76 | gg tct cac acc ctc cag T | (SEQ ID No: 714) |
| 77 | cc aga cca gca gga gaC | (SEQ ID No: 715) |
| 78 | cc ctg aga tgg gag ccA | (SEQ ID No: 716) |
| 79 | c atg agg tat ttc tac acc G | (SEQ ID No: 717) |
| 80 | c tcc cac tcc atg agg C | (SEQ ID No: 718) |
| 81 | g cag gag ggg ccg gaA | (SEQ ID No: 719) |
| 82 | g gag tgg ctc cgc aga C | (SEQ ID No: 720) |
| 83 | g acg ctg cag cyc gcG | (SEQ ID No: 721) |

TABLE 5-3-continued

| Probe No. | Base Sequence | |
|---|---|---|
| 84 | c acc ctc cag agg atg taT | (SEQ ID No: 722) |
| 85 | tc ctg ctg ctc tcg ggA | (SEQ ID No: 723) |
| 86 | gcg ccc cgg gcg ccA | (SEQ ID No: 724) |
| 87 | gag tat tgg gac cgg gaG | (SEQ ID No: 725) |
| 88 | c cgt gag gcg gag cag T | (SEQ ID No: 726) |
| 89 | gac caa act cag gac acC | (SEQ ID No: 727) |
| 90 | cc gcc tac gac ggc aaA | (SEQ ID No: 728) |

TABLE 5-4

| Probe No. | Base Sequence | |
|---|---|---|
| 91 | g agc tcc tgg acc gcG | (SEQ ID No: 729) |
| 92 | g gat tac atc gcc ctg aaT | (SEQ ID No: 730) |
| 93 | c gac acg cag ttc gtg C | (SEQ ID No: 731) |
| 94 | cag atc tcc aag acc aac A | (SEQ ID No: 732) |
| 95 | c gga gct gtg gtc gct A | (SEQ ID No: 733) |
| 96 | c acc ctc cag agg atg tT | (SEQ ID No: 734) |
| 97 | tac gcc tac gac ggc aaA | (SEQ ID No: 735) |
| 98 | cag atc tgc aag acc aac A | (SEQ ID No: 736) |
| 99 | cg agt ccg agg atg gcT | (SEQ ID No: 737) |
| 100 | g ggc ctg tgc gtg gaC | (SEQ ID No: 738) |
| 101 | gg gcc ggc tcc cac tT | (SEQ ID No: 739) |
| 102 | ac atg aag gcc tcc gcG | (SEQ ID No: 740) |
| 103 | gca gct gtg gtg gtg cT | (SEQ ID No: 741) |
| 104 | gtg acc cac cac ccc G | (SEQ ID No: 742) |
| 105 | g tat tgg gac cgg gag aT | (SEQ ID No: 743) |
| 106 | gcg agt ccg agg atg gC | (SEQ ID No: 744) |
| 107 | c acc ctc cag agg atg tC | (SEQ ID No: 745) |
| 108 | gg acc gcc gcg gac aA | (SEQ ID No: 746) |
| 109 | g atg tac ggc tgc gac C | (SEQ ID No: 747) |
| 110 | g tct cac acc ctc cag aC | (SEQ ID No: 748) |
| 111 | ct cac acc ctc cag acG | (SEQ ID No: 749) |
| 112 | ac cga gag aac ctg cgC | (SEQ ID No: 750) |
| 113 | c ggg aag gag acg ctg C | (SEQ ID No: 751) |
| 114 | cc ctg aac gag gac ctg A | (SEQ ID No: 752) |
| 115 | g gag ccc cgc ttc atc G | (SEQ ID No: 753) |
| 116 | agg tat ttc tac acc gcc A | (SEQ ID No: 754) |
| 117 | t ccg agg atg gcg ccC | (SEQ ID No: 755) |
| 118 | g ttc gac agc gac gcc A | (SEQ ID No: 756) |

TABLE 5-4-continued

| Probe No. | Base Sequence | |
|---|---|---|
| 119 | gag ccg cgg gcg ccA | (SEQ ID No: 757) |
| 120 | g gcg gag cag ctg aga A | (SEQ ID No: 758) |

TABLE 5-5

| Probe No. | Base Sequence | |
|---|---|---|
| 121 | a acc tac ctg gag ggc C | (SEQ ID No: 759) |
| 122 | acc tac ctg gag ggc CT | (SEQ ID No: 760) |
| 123 | c tcc aag acc aac aca cG | (SEQ ID No: 761) |
| 124 | c tac gtg gac gac acg cT | (SEQ ID No: 762) |
| 125 | c cgg gag aca cag atc tT | (SEQ ID No: 763) |
| 126 | ac aca cag act tac cga gT | (SEQ ID No: 764) |
| 127 | ca cag act tac cga gtg aA | (SEQ ID No: 765) |
| 128 | c cgc ggg cat aac cag tT | (SEQ ID No: 766) |
| 129 | cc cag ttc gtg agg ttc A | (SEQ ID No: 767) |
| 130 | c cgg gag aca cag atc tG | (SEQ ID No: 768) |
| 131 | g gct cag atc acc cag cA | (SEQ ID No: 769) |
| 132 | acc tac ctg gag ggc aC | (SEQ ID No: 770) |
| 133 | cac tcc atg agg tat ttc C | (SEQ ID No: 771) |
| 134 | gac ccc cca aag aca caT | (SEQ ID No: 772) |
| 135 | gag aca cag atc tcc aag aT | (SEQ ID No: 773) |
| 136 | gg gag gcg gcc cgt C | (SEQ ID No: 774) |
| 137 | gcg ccg tgg ata gag caA | (SEQ ID No: 775) |
| 138 | g acc aac aca cag act tac A | (SEQ ID No: 776) |
| 139 | ac acc ctc cag aat atg taT | (SEQ ID No: 777) |
| 140 | g gag ccc cgc ttc att G | (SEQ ID No: 778) |
| 141 | g gat tac atc gcc ctg aaG | (SEQ ID No: 779) |
| 142 | c acc ctc cag agg atg tG | (SEQ ID No: 780) |
| 143 | gcg ccg tgg ata gag caA | (SEQ ID No: 781) |
| 144 | cga gag aac ctg cgc aC | (SEQ ID No: 782) |
| 145 | gag aac ctg cgc acc gC | (SEQ ID No: 783) |
| 146 | g tct cac acc ctc cag aaT | (SEQ ID No: 784) |
| 147 | cag gag ggg ccg gag C | (SEQ ID No: 785) |
| 148 | ctg ggc ttc tac cct gG | (SEQ ID No: 786) |
| 149 | ca cag act gac cga gag G | (SEQ ID No: 787) |
| 150 | c gcc gcg gac acg gcA | (SEQ ID No: 788) |

TABLE 5-6

| Probe No. | Base Sequence | |
|---|---|---|
| 151 | ctg ctc tgg ggg gca G | (SEQ ID No: 789) |
| 152 | c cag agc gag gcc ggT | (SEQ ID No: 790) |
| 153 | c tcc gtg tcc cgg ccT | (SEQ ID No: 791) |
| 154 | cgc ggg tac cac cag C | (SEQ ID No: 792) |
| 155 | tg acc gag acc tgg gcT | (SEQ ID No: 793) |
| 156 | cag gag ggg ccg gag tT | (SEQ ID No: 794) |
| 157 | cga gag agc ctg cgg aC | (SEQ ID No: 795) |
| 158 | c acg gcg gct cag atc T | (SEQ ID No: 796) |
| 159 | cg gag cag ctg aga gcT | (SEQ ID No: 797) |
| 160 | gg ccc gac ggg cgc T | (SEQ ID No: 798) |
| 161 | cgc ggg cat gac cag tT | (SEQ ID No: 799) |
| 162 | cc atg tcc cgg ccc gT | (SEQ ID No: 800) |
| 163 | g acc gcg gcg gac acC | (SEQ ID No: 801) |
| 164 | c tgc gac gtg ggg ccC | (SEQ ID No: 802) |
| 165 | t ccg agg acg gag ccC | (SEQ ID No: 803) |
| 166 | gag ccc cgg gcg ccA | (SEQ ID No: 804) |
| 167 | cc gcg agt ccg agg aC | (SEQ ID No: 805) |
| 168 | cac atc atc cag agg atg tT | (SEQ ID No: 806) |
| 169 | ca cag act tac cga gag aA | (SEQ ID No: 807) |
| 170 | c atg tac ggc tgc gac C | (SEQ ID No: 808) |
| 171 | ctg cgg aac ctg cgc gA | (SEQ ID No: 809) |
| 172 | cat gac cag tcc gcc tG | (SEQ ID No: 810) |
| 173 | c acc atc cag agg atg tC | (SEQ ID No: 811) |
| 174 | gac ctg agc tcc tgg acA | (SEQ ID No: 812) |
| 175 | cga gag agc ctg cgc aC | (SEQ ID No: 813) |
| 176 | g cag gag ggg ccg gG | (SEQ ID No: 814) |
| 177 | ga acc tac ctg gag ggc A | (SEQ ID No: 815) |
| 178 | a acc tac ctg gag ggc aT | (SEQ ID No: 816) |
| 179 | c tgg acc gcg gcg gaG | (SEQ ID No: 817) |
| 180 | ta gag cag gag ggg ccA | (SEQ ID No: 818) |

TABLE 5-7

| Probe No. | Base Sequence | |
|---|---|---|
| 181 | tct cac act tgg cag acG | (SEQ ID No: 819) |
| 182 | g gcg gag cag cgg aga A | (SEQ ID No: 820) |
| 183 | cgg ccc ggc cgc ggA | (SEQ ID No: 821) |
| 184 | gg tct cac acc ctc caC | (SEQ ID No: 822) |
| 185 | c cgc ggg tat aac cag ttA | (SEQ ID No: 823) |

TABLE 5-7-continued

| Probe No. | Base Sequence | |
|---|---|---|
| 186 | g gcg gag cag tgg aga A | (SEQ ID No: 824) |
| 187 | gaa tat tgg gac cgg gaG | (SEQ ID No: 825) |
| 188 | gcg gct cag atc acc cG | (SEQ ID No: 826) |
| 189 | cac acc ctc cag agc aC | (SEQ ID No: 827) |
| 190 | ag tgg gag gcg gcc cT | (SEQ ID No: 828) |
| 191 | g acc gag acc tgg gcG | (SEQ ID No: 829) |
| 192 | c gcc acg agt ccg agg A | (SEQ ID No: 830) |
| 193 | g atc tcc cag cgc aag tT | (SEQ ID No: 831) |
| 194 | tg gag gcg gcc cgt gT | (SEQ ID No: 832) |
| 195 | tg acc gag acc tgg gcl | (SEQ ID No: 833) |
| 196 | g cgc tcc tgg acc gcG | (SEQ ID No: 834) |
| 197 | ag ggc gag tgc gtg gaT | (SEQ ID No: 835) |
| 198 | gg tat ttc cac acc gcc A | (SEQ ID No: 836) |
| 199 | c cgc ggg cat aac cag A | (SEQ ID No: 837) |
| 200 | ccg gag tat tgg gac cC | (SEQ ID No: 838) |
| 201 | gg tct cac atc atc cag G | (SEQ ID No: 839) |
| 202 | c gcc tac gac ggc aag A | (SEQ ID No: 840) |
| 203 | cgc ggg cat aac cag tC | (SEQ ID No: 841) |
| 204 | cc ggg tct cac act tgG | (SEQ ID No: 842) |
| 205 | c act tgg cag agg atg taT | (SEQ ID No: 843) |
| 206 | ga gag agc ctg cgg aaG | (SEQ ID No: 844) |
| 207 | c ggg aag gac acg ctg C | (SEQ ID No: 845) |
| 208 | c acg ctg cag cgc gcG | (SEQ ID No: 846) |
| 209 | cc atc tct gac cat gag gT | (SEQ ID No: 847) |
| 210 | cgg gag aca cag atc tcG | (SEQ ID No: 848) |

TABLE 5-8

| Probe No. | Base Sequence | |
|---|---|---|
| 211 | g gag gcg gcc cgt gtC | (SEQ ID No: 849) |
| 212 | a gag aac ctg cgc acc G | (SEQ ID No: 850) |
| 213 | gg gag ccc cgc ttc atT | (SEQ ID No: 851) |
| 214 | ctg cgc acc ccg ctc C | (SEQ ID No: 852) |
| 215 | gg ccg gag tat tgg gaG | (SEQ ID No: 853) |
| 216 | c cgc ggg cat aac cag G | (SEQ ID No: 854) |
| 217 | ggc gag tgc gtg gag tC | (SEQ ID No: 855) |
| 218 | cgg gcg ccg tgg gtG | (SEQ ID No: 856) |
| 219 | ga gag aac ctg cgg atc G | (SEQ ID No: 857) |

TABLE 5-8-continued

| Probe No. | Base Sequence | |
|---|---|---|
| 220 | gtg gac gac acg ctg ttG | (SEQ ID No: 858) |
| 221 | tg gag ggc ctg tgc gC | (SEQ ID No: 859) |
| 222 | gac ggc aag gat tac atc A | (SEQ ID No: 860) |
| 223 | c cgc ggg tat aac cag tT | (SEQ ID No: 861) |
| 224 | ctc cgc ggg tat aac cG | (SEQ ID No: 862) |
| 225 | gcg gag cag gac aga gT | (SEQ ID No: 863) |
| 226 | gag aca cag aag tac aag C | (SEQ ID No: 864) |
| 227 | cgc cag gca cag act gG | (SEQ ID No: 865) |
| 228 | t gtg gtc gct gct gtg G | (SEQ ID No: 866) |
| 229 | c ctg cgg aac ctg ctc C | (SEQ ID No: 867) |
| 230 | aga acc ttc cag aag tgg A | (SEQ ID No: 868) |
| 231 | ag ccc cgc ttc atc tcC | (SEQ ID No: 869) |
| 232 | c cgc ggg tat aac cag ttA | (SEQ ID No: 870) |
| 233 | ggc ctg tgc gtg gag G | (SEQ ID No: 871) |
| 234 | cgg atc gcg ctc cgc G | (SEQ ID No: 872) |
| 235 | ttc gcc tac gac ggc aaA | (SEQ ID No: 873) |
| 236 | ctc ctc cgc ggg cat aaA | (SEQ ID No: 874) |
| 237 | g cgt ctc ctc cgc ggT | (SEQ ID No: 875) |
| 238 | c ggg cgc ctc ctc cC | (SEQ ID No: 876) |
| 239 | g agt ccg agg acg gag A | (SEQ ID No: 877) |
| 240 | ata gag cag gag ggg cG | (SEQ ID No: 878) |

TABLE 5-9

| Probe No. | Base Sequence | |
|---|---|---|
| 241 | cc aga cca gca gga gat G | (SEQ ID No: 879) |
| 242 | cag cat gag ggg ctg cT | (SEQ ID No: 880) |
| 243 | cag act tac cga gag aac T | (SEQ ID No: 881) |
| 244 | gc gac gcc gcg agt cA | (SEQ ID No: 882) |
| 245 | c cgc ggg gag ccc cC | (SEQ ID No: 883) |
| 246 | cga gag agc ctg cgg aT | (SEQ ID No: 884) |
| 247 | gag agc ctg cgg atc gC | (SEQ ID No: 885) |
| 248 | g gca cag act gac cga gT | (SEQ ID No: 886) |
| 249 | g acc gcc gcg gac acC | (SEQ ID No: 887) |
| 250 | g cag gag ggg ccg gC | (SEQ ID No: 888) |
| 251 | cc gcg agt ccg aga gG | (SEQ ID No: 889) |
| 252 | gg tct cac act tgg cag aT | (SEQ ID No: 890) |
| 253 | acg gca ccc cga acc C | (SEQ ID No: 891) |
| 254 | ctc ctc ctg ctg ctc tG | (SEQ ID No: 892) |

TABLE 5-9-continued

| Probe No. | Base Sequence | |
|---|---|---|
| 255 | ag aca cag aag tac aag gG | (SEQ ID No: 893) |
| 256 | gg tct cac atc atc cag gT | (SEQ ID No: 894) |
| 257 | gc ggg cat gac cag tcT | (SEQ ID No: 895) |
| 258 | g acc gcg gcg gac acA | (SEQ ID No: 896) |
| 259 | g ccg gag tat tgg gac G | (SEQ ID No: 897) |
| 260 | c ctc ctc cgc ggg tat A | (SEQ ID No: 898) |
| 261 | c acg gcg gct cag atc aT | (SEQ ID No: 899) |
| 262 | tg cgg atc gcg ctc cC | (SEQ ID No: 900) |
| 263 | g ccg gag tat tgg gac gA | (SEQ ID No: 901) |
| 264 | g gag gcg gcc cgt gC | (SEQ ID No: 902) |
| 265 | c gac gcc gcg agt ccA | (SEQ ID No: 903) |
| 266 | gtc acc gta gct gtg gtC | (SEQ ID No: 904) |
| 267 | g tgt agg agg aag agt tcT | (SEQ ID No: 905) |
| 268 | c aga gcc tac ctg gag gA | (SEQ ID No: 906) |
| 269 | gtc atc gga gct gtg gtT | (SEQ ID No: 907) |

TABLE 6-1

| Probe No. | Base Sequence | |
|---|---|---|
| 0 | c acc tcc Gtg tcc cgg | (SEQ ID No: 908) |
| 1 | c ctc cag agC atg tac gg | (SEQ ID No: 909) |
| 2 | c cgc ggg Cat gac cag | (SEQ ID No: 910) |
| 3 | cat gac cag Tac gcc tac | (SEQ ID No: 911) |
| 4 | g gag cag cGg aga gcc | (SEQ ID No: 912) |
| 5 | gag cag cgG aga gcc ta | (SEQ ID No: 913) |
| 6 | g gag ggc gAg tgc gtg | (SEQ ID No: 914) |
| 7 | c gtg gag tGg ctc cgc | (SEQ ID No: 915) |
| 8 | ac aag ctg Gag cgc gct | (SEQ ID No: 916) |
| 9 | ctc cgc agG tac ctg ga | (SEQ ID No: 917) |
| 10 | g gac gac acG cag ttc gt | (SEQ ID No: 918) |
| 11 | aag acc aac Aca cag act g | (SEQ ID No: 919) |
| 12 | g gag cag gaC aga gcc ta | (SEQ ID No: 920) |
| 13 | cgc ggg cat Aac cag tac | (SEQ ID No: 921) |
| 14 | cag tcc acc Atc ccc atc | (SEQ ID No: 922) |
| 15 | c ctc cag agG atg tac gg | (SEQ ID No: 923) |
| 16 | aca cag atc tTc aag acc aa | (SEQ ID No: 924) |
| 17 | t gac cag tCc gcc tac g | (SEQ ID No: 925) |
| 18 | ca cag atc tGc aag gcc C | (SEQ ID No: 926) |

TABLE 6-1-continued

| Probe No. | Base Sequence | |
|---|---|---|
| 19 | c cga gag aAc ctg cgg a | (SEQ ID No: 927) |
| 20 | tct cac atc Atc cag agg a | (SEQ ID No: 928) |
| 21 | g agg atg taT ggc tgc ga | (SEQ ID No: 929) |
| 22 | c tgc gac Ctg ggg ccc | (SEQ ID No: 930) |
| 23 | ctg ggg ccC gac ggg | (SEQ ID No: 931) |
| 24 | g tac aag cGc cag gca c | (SEQ ID No: 932) |
| 25 | ag gca cag Gct gac cga | (SEQ ID No: 933) |
| 26 | t gac cga gTg agc ctg c | (SEQ ID No: 934) |
| 27 | gg tct cac aTc atc cag ag | (SEQ ID No: 935) |
| 28 | c atc cag agG atg tac gg | (SEQ ID No: 936) |
| 29 | tc cgc ggg Tat gac cag | (SEQ ID No: 937) |
| 30 | aag acc aac Aca cag act ta | (SEQ ID No: 938) |

TABLE 6-2

| Probe No. | Base Sequence | |
|---|---|---|
| 31 | aca cag act Tac cga gag a | (SEQ ID No: 939) |
| 32 | g gag ggc aCg tgc gtg | (SEQ ID No: 940) |
| 33 | ggg aag gaG acg ctg ga | (SEQ ID No: 941) |
| 34 | g aag gag aCg ctg gag c | (SEQ ID No: 942) |
| 35 | g gag ggc cTg tgc gtg | (SEQ ID No: 943) |
| 36 | c gtg gag tCg ctc cgc | (SEQ ID No: 944) |
| 37 | c ggg gag cTc cgc ttc | (SEQ ID No: 945) |
| 38 | c gcc gcg Aac acg gcg | (SEQ ID No: 946) |
| 39 | tg cgc ggc Cac tac aac | (SEQ ID No: 947) |
| 40 | g gag ggc Ctg tgc gtg | (SEQ ID No: 948) |
| 41 | g gcc cgt gTg gcg gag | (SEQ ID No: 949) |
| 42 | g gag cag cTg aga gcc t | (SEQ ID No: 950) |
| 43 | ca cag atc tCc aag acc aa | (SEQ ID No: 951) |
| 44 | aca cag act Tac cga gag g | (SEQ ID No: 952) |
| 45 | c cga gag Gac ctg cgg | (SEQ ID No: 953) |
| 46 | cc ctg ctc Cgc tac tac | (SEQ ID No: 954) |
| 47 | tat gac cag Gac gcc tac | (SEQ ID No: 955) |
| 48 | agg tat ttc Gac acc gcc | (SEQ ID No: 956) |
| 49 | c acc gcc Atg tcc cgg | (SEQ ID No: 957) |
| 50 | gag ccg cCg gcg ccg | (SEQ ID No: 958) |
| 51 | g gag ggc Acg tgc gtg | (SEQ ID No: 959) |
| 52 | g agg aag agC tca ggt gg | (SEQ ID No: 960) |
| 53 | cc gcg ctc Cgc tac tac | (SEQ ID No: 961) |

TABLE 6-2-continued

| Probe No. | Base Sequence | |
|---|---|---|
| 54 | c ctg cgg aTc gcg ctc | (SEQ ID No: 962) |
| 55 | g cgg atc gCg ctc cgc | (SEQ ID No: 963) |
| 56 | tc gcg ctc Cgc tac tac | (SEQ ID No: 964) |
| 57 | g aag gac aCg ctg gag c | (SEQ ID No: 965) |
| 58 | ac aca cag aCc ttc aag ac | (SEQ ID No: 966) |
| 59 | g acg atg taT ggc tgc ga | (SEQ ID No: 967) |
| 60 | gg gac cgg Gac aca cag | (SEQ ID No: 968) |
| 61 | ac cac cag Gac gcc tac | (SEQ ID No: 969) |

TABLE 6-3

| Probe No. | Base Sequence | |
|---|---|---|
| 62 | aac aca cag Gct gac cga | (SEQ ID No: 970) |
| 63 | gcc ctg ggC ttc tac cc | (SEQ ID No: 971) |
| 64 | c acc cag cTc aag tgg g | (SEQ ID No: 972) |
| 65 | ct tgg cag aCg atg tat gg | (SEQ ID No: 973) |
| 66 | t aac cag ttA gcc tac gac | (SEQ ID No: 974) |
| 67 | c tgc gac Ctg ggg ccg | (SEQ ID No: 975) |
| 68 | a tct tcc caA tcc acc gtc | (SEQ ID No: 976) |
| 69 | g aga gcc tGc ctg gag g | (SEQ ID No: 977) |
| 70 | acc ctc cag Tgg atg tat g | (SEQ ID No: 978) |
| 71 | a gca gga gaG aga acc ttc | (SEQ ID No: 979) |
| 72 | a tgg gag ccA tct tcc ca | (SEQ ID No: 980) |
| 73 | tc tac acc Gcc gtg tcc | (SEQ ID No: 981) |
| 74 | tcc atg agg Cat ttc tac ac | (SEQ ID No: 982) |
| 75 | g ggg ccg gaA tat tgg ga | (SEQ ID No: 983) |
| 76 | tc cgc aga Cac ctg gag | (SEQ ID No: 984) |
| 77 | g acg ctg Cag cgc gcg | (SEQ ID No: 985) |
| 78 | ctc tcg ggA gcc ctg g | (SEQ ID No: 986) |
| 79 | cgg gcg ccA tgg ata ga | (SEQ ID No: 987) |
| 80 | g gac cgg gaG aca cag at | (SEQ ID No: 988) |
| 81 | cg gag cag Tgg aga gcc | (SEQ ID No: 989) |
| 82 | t cag gac acC gag ctt gt | (SEQ ID No: 990) |
| 83 | c gac ggc aaA gat tac atc | (SEQ ID No: 991) |
| 84 | tgg acc gcG gcg gac a | (SEQ ID No: 992) |
| 85 | a gcc ctg aaT gag gac ct | (SEQ ID No: 993) |
| 86 | cag ttc gtg Cgg ttc gac | (SEQ ID No: 994) |
| 87 | gtg gtc gct Act gtg atg | (SEQ ID No: 995) |

TABLE 6-3-continued

| Probe No. | Base Sequence | |
|---|---|---|
| 88 | ag agg atg tTt ggc tgc g | (SEQ ID No: 996) |
| 89 | ca cag atc tGc aag acc aa | (SEQ ID No: 997) |
| 90 | agg atg gcT ccc cgg g | (SEQ ID No: 998) |
| 91 | tgc gtg gaC ggg ctc c | (SEQ ID No: 999) |
| 92 | gc tcc cac tTc atg agg t | (SEQ ID No: 1000) |

TABLE 6-4

| Probe No. | Base Sequence | |
|---|---|---|
| 93 | gcc tcc gcG cag act ta | (SEQ ID No: 1001) |
| 94 | tg gtg gtg cTt tct gga g | (SEQ ID No: 1002) |
| 95 | ac cac ccc Gtc tct gac | (SEQ ID No: 1003) |
| 96 | ac cgg gag aTa cag atc tc | (SEQ ID No: 1004) |
| 97 | g agg atg gCg ccc cgg | (SEQ ID No: 1005) |
| 98 | g agg atg tCt ggc tgc g | (SEQ ID No: 1006) |
| 99 | a gcg gac aAg gcg gct | (SEQ ID No: 1007) |
| 100 | cc ctc cag aCg atg tac g | (SEQ ID No: 1008) |
| 101 | c ctc cag acG atg tac gg | (SEQ ID No: 1009) |
| 102 | aac ctg cgC acc gcg c | (SEQ ID No: 1010) |
| 103 | ag gac ctg Agc tcc tgg | (SEQ ID No: 1011) |
| 104 | gc ttc atc Gca gtg ggc | (SEQ ID No: 1012) |
| 105 | atg gcg ccC cgg gcg | (SEQ ID No: 1013) |
| 106 | c gac gcc Acg agt ccg | (SEQ ID No: 1014) |
| 107 | cag ctg aga Acc tac ctg | (SEQ ID No: 1015) |
| 108 | cc aac aca cGg act tac c | (SEQ ID No: 1016) |
| 109 | ggg aag gaG acg ctg ca | (SEQ ID No: 1017) |
| 110 | ac gac acg cTg ttc gtg a | (SEQ ID No: 1018) |
| 111 | ct tac cga gTg aac ctg c | (SEQ ID No: 1019) |
| 112 | c cga gtg aAc ctg cgg a | (SEQ ID No: 1020) |
| 113 | at aac cag tTc gcc tac ga | (SEQ ID No: 1021) |
| 114 | gtg agg ttc Aac agc gac | (SEQ ID No: 1022) |
| 115 | c acc cag cAc aag tgg g | (SEQ ID No: 1023) |
| 116 | cg gag cag cig aga acc t | (SEQ ID No: 1024) |
| 117 | agg tat ttc Cac acc tcc g | (SEQ ID No: 1025) |
| 118 | a aag aca caT gtg acc cac | (SEQ ID No: 1026) |
| 119 | atc tcc aag aTc aac aca ca | (SEQ ID No: 1027) |
| 120 | g gcc cgt Cag gcg gag | (SEQ ID No: 1028) |
| 121 | g ata gag caA gag ggg cc | (SEQ ID No: 1029) |

TABLE 6-4-continued

| Probe No. | Base Sequence | |
|---|---|---|
| 122 | cag act tac Aga gag agc c | (SEQ ID No: 1030) |
| 123 | g aat atg taT ggc tgc gac | (SEQ ID No: 1031) |

TABLE 6-5

| Probe No. | Base Sequence | |
|---|---|---|
| 124 | cgc ttc att Gca gtg ggc | (SEQ ID No: 1032) |
| 125 | gcc ctg aaG gag gac ct | (SEQ ID No: 1033) |
| 126 | ct tac cga gTg agc ctg c | (SEQ ID No: 1034) |
| 127 | g agg atg tGc ggc tgc g | (SEQ ID No: 1035) |
| 128 | g ata gag caA gag ggg cc | (SEQ ID No: 1036) |
| 129 | ca cag atc tGc aag gcc a | (SEQ ID No: 1037) |
| 130 | c ctg cgc aCc gcg ctc | (SEQ ID No: 1038) |
| 131 | cgc acc gCg ctc cgc | (SEQ ID No: 1039) |
| 132 | c ctc cag aaT atg tat ggc | (SEQ ID No: 1040) |
| 133 | gg ccg gag Cat tgg gac | (SEQ ID No: 1041) |
| 134 | tc tac cct gGg gag atc a | (SEQ ID No: 1042) |
| 135 | g gac acg gcA gct cag at | (SEQ ID No: 1043) |
| 136 | g ggg gca Gtg gcc ctg | (SEQ ID No: 1044) |
| 137 | gag gcc ggT tct cac ac | (SEQ ID No: 1045) |
| 138 | tcc cgg ccT ggc cgc | (SEQ ID No: 1046) |
| 139 | ac cac cag Cac gcc tac | (SEQ ID No: 1047) |
| 140 | acc tgg gcT ggc tcc c | (SEQ ID No: 1048) |
| 141 | g gtc acg gAg ccc cga | (SEQ ID No: 1049) |
| 142 | g ccg gag tTt tgg gac c | (SEQ ID No: 1050) |
| 143 | c ctc cag aaT atg tac ggc | (SEQ ID No: 1051) |
| 144 | C ctg cgg aCc ctg ctc | (SEQ ID No: 1052) |
| 145 | ct cag atc Tcc cag cgc | (SEQ ID No: 1053) |
| 146 | g ctg aga gcT tac ctg ga | (SEQ ID No: 1054) |
| 147 | c ggg cgc Ttc ctc cgc | (SEQ ID No: 1055) |
| 148 | at gac cag tTc gcc tac g | (SEQ ID No: 1056) |
| 149 | cgc ggg cat Aac cag ttc | (SEQ ID No: 1057) |
| 150 | cgg ccc gTc cgc ggg | (SEQ ID No: 1058) |
| 151 | gcg gac acC gcg gct c | (SEQ ID No: 1059) |
| 152 | tct cac atc Atc cag agc a | (SEQ ID No: 1060) |
| 153 | gtg ggg ccC gac ggg | (SEQ ID No: 1061) |
| 154 | acg gag ccC cgg gcg | (SEQ ID No: 1062) |

TABLE 6-6

| Probe No. | Base Sequence | |
|---|---|---|
| 155 | t ccg agg aCg gag ccc | (SEQ ID No: 1063) |
| 156 | ac ctg cgc gAc tac tac a | (SEQ ID No: 1064) |
| 157 | g tcc gcc tGc gac ggc | (SEQ ID No: 1065) |
| 158 | tcc tgg acA gcg gcg g | (SEQ ID No: 1066) |
| 159 | c cga gag aAc ctg cgc a | (SEQ ID No: 1067) |
| 160 | g ggg ccg gGa tat tgg g | (SEQ ID No: 1068) |
| 161 | tg gag ggc Atg tgc gtg | (SEQ ID No: 1069) |
| 162 | g gag ggc aTg tgc gtg g | (SEQ ID No: 1070) |
| 163 | gcg gcg gaG acc gcg | (SEQ ID No: 1071) |
| 164 | g gag ggg ccA gaa tat tg | (SEQ ID No: 1072) |
| 165 | ct tgg cag aCg atg tac g | (SEQ ID No: 1073) |
| 166 | t tgg cag acG atg tac gg | (SEQ ID No: 1074) |
| 167 | cag cgg aga Acc tac ctg | (SEQ ID No: 1075) |
| 168 | ggc cgc ggA gag ccc | (SEQ ID No: 1076) |
| 169 | c acc ctc caC agg atg ta | (SEQ ID No: 1077) |
| 170 | cg gag cag Tgg aga acc | (SEQ ID No: 1078) |
| 171 | cag tgg aga Acc tac ctg | (SEQ ID No: 1079) |
| 172 | g atc acc cGg cgc aag t | (SEQ ID No: 1080) |
| 173 | c cag agc aCg tac ggc t | (SEQ ID No: 1081) |
| 174 | g gcg gcc cTt gtg gcg | (SEQ ID No: 1082) |
| 175 | acc tgg gcG ggc tcc c | (SEQ ID No: 1083) |
| 176 | gtc acg gcA ccc cga ac | (SEQ ID No: 1084) |
| 177 | agg tat ttc Cac acc gcc | (SEQ ID No: 1085) |
| 178 | gt ccg agg Aag gag ccg | (SEQ ID No: 1086) |
| 179 | g cgc aag tTg gag gcg g | (SEQ ID No: 1087) |
| 180 | acc tgg gcT ggc tcc c | (SEQ ID No: 1088) |
| 181 | tgc gtg gaT tgg ctc cg | (SEQ ID No: 1089) |
| 182 | cat aac cag Aac gcc tac g | (SEQ ID No: 1090) |
| 183 | t tgg gac cCg gag aca c | (SEQ ID No: 1091) |
| 184 | atc atc cag Gtg atg tat gg | (SEQ ID No: 1092) |
| 185 | gac ggc aag Aat tac atc g | (SEQ ID No: 1093) |

TABLE 6-7

| Probe No. | Base Sequence | |
|---|---|---|
| 186 | at aac cag tCc gcc tac g | (SEQ ID NO: 1094) |
| 187 | ctg cgg aaG ctg cgc g | (SEQ ID No: 1095) |
| 188 | t cac act tgG cag agg atg | (SEQ ID No: 1096) |
| 189 | c acg ctg Cag cgc gcg | (SEQ ID No: 1097) |

TABLE 6-7-continued

| Probe No. | Base Sequence | |
|---|---|---|
| 190 | ac cat gag gTc acc ctg a | (SEQ ID No: 1098) |
| 191 | a cag atc tcG aag acc aac | (SEQ ID No: 1099) |
| 192 | gcc cgt gtC gcg gag c | (SEQ ID No. 1100) |
| 193 | g cgc acc Gcg ctc cg | (SEQ ID No: 1101) |
| 194 | c cgc ttc atT gca gtg gg | (SEQ ID No: 1102) |
| 195 | c ctg cgc aCc ccg ctc | (SEQ ID No: 1103) |
| 196 | cc ccg ctc Cgc tac tac | (SEQ ID No: 1104) |
| 197 | g tat tgg gaG cgg gag ac | (SEQ ID No: 1105) |
| 198 | gc ggg cat Aac cag gac | (SEQ ID No: 1106) |
| 199 | cat aac cag Gac gcc tac | (SEQ ID No: 1107) |
| 200 | ctc cgc ggg Tat aac cag | (SEQ ID No: 1108) |
| 201 | ccg tgg gtG gag cag g | (SEQ ID No: 1109) |
| 202 | g cgg atc Gcg ctc cgc | (SEQ ID No: 1110) |
| 203 | c acg ctg ttG gtg agg tt | (SEQ ID No: 1111) |
| 204 | c ctg tgc gCg gag tcg | (SEQ ID No: 1112) |
| 205 | gat tac atc Acc ctg aac g | (SEQ ID No: 1113) |
| 206 | gg tat aac cGg tta gcc ta | (SEQ ID No: 1114) |
| 207 | ag gac aga gTc tac ctg g | (SEQ ID No: 1115) |
| 208 | aag tac aag Cgc cag gca | (SEQ ID No: 1116) |
| 209 | ca cag act gGc cga gtg a | (SEQ ID No: 1117) |
| 210 | gct gct gtg Gtg tgt agg | (SEQ ID No: 1118) |
| 211 | aac ctg ctc Cgc tac tac | (SEQ ID No: 1119) |
| 212 | cag aag tgg Aca gct gtg | (SEQ ID No: 1120) |
| 213 | cag cgc gcG gac ccc | (SEQ ID No: 1121) |
| 214 | c ttc atc tcC gtg ggc ta | (SEQ ID No: 1122) |
| 215 | c gtg gag Ggg ctc cgc | (SEQ ID No: 1123) |
| 216 | cg ctc cgc Gac tac aac | (SEQ ID No: 1124) |

TABLE 6-8

| Probe No. | Base Sequence | |
|---|---|---|
| 217 | c ggg cat aaA cag tac gc | (SEQ ID No: 1125) |
| 218 | c ctc cgc ggT tat aac ca | (SEQ ID No: 1126) |
| 219 | c ctc ctc cCc ggg cat | (SEQ ID No: 1127) |
| 220 | g acg gag Acc cgg gcg | (SEQ ID No: 1128) |
| 221 | g gag ggg cGg gag tat t | (SEQ ID No: 1129) |
| 222 | gca gga gat Gga acc ttc | (SEQ ID No: 1130) |
| 223 | g ggg ctg cTg aag ccc | (SEQ ID No: 1131) |
| 224 | cgg gtc aCg gcg ccc | (SEQ ID No: 1132) |
| 225 | t ccg agg aCg gag ccg | (SEQ ID No: 1133) |
| 226 | cga gag aac Ttg cgg atc | (SEQ ID No: 1134) |
| 227 | c gcg agt cAg agg acg g | (SEQ ID No: 1135) |
| 228 | g gag ccc cCc ttc atc g | (SEQ ID No: 1136) |
| 229 | g ggg ccg gCg tat tgg | (SEQ ID No: 1137) |
| 230 | t ccg aga gGg gag ccg | (SEQ ID No: 1138) |
| 231 | ct tgg cag aTg atg tat gg | (SEQ ID No: 1139) |
| 232 | g tac aag gGc cag gca c | (SEQ ID No: 1140) |
| 233 | tc atc cag gTg atg tat gg | (SEQ ID No: 1141) |
| 234 | t gac cag tcT gcc tac ga | (SEQ ID No: 1142) |
| 235 | gcg gac acA gcg gct c | (SEQ ID No: 1143) |
| 236 | tat tgg gac Ggg gag aca | (SEQ ID No: 1144) |
| 237 | cgc ggg tat Aac cag tac | (SEQ ID No: 1145) |
| 238 | ct cag atc aTc cag cgc a | (SEQ ID No: 1146) |
| 239 | c gcg ctc cCc tac tac a | (SEQ ID No: 1147) |
| 240 | at tgg gac gAg gag aca c | (SEQ ID No: 1148) |
| 241 | gcc cgt gCg gcg gag | (SEQ ID No: 1149) |
| 242 | g aag gag aCg ctg cag c | (SEQ ID No: 1150) |
| 243 | gcg agt ccA aga ggg ga | (SEQ ID No: 1151) |
| 244 | gct gtg gtC gct gtg gt | (SEQ ID No: 1152) |
| 245 | c ctg gag gAc ctg tgc g | (SEQ ID No: 1153) |
| 246 | a gct gtg gtT gct act gtg | (SEQ ID No: 1154) |

TABLE 7

Allele-Probe List 1

| | | | | | | | | | |
|---|---|---|---|---|---|---|---|---|---|
| B*070201 | 0 | 1 | 2 | 3 | 4 | 5 | 6 | 7 | 8 |
| B*070202 | 9 | | | | | | | | |
| B*070203 | 10 | | | | | | | | |
| B*0703 | 11 | | | | | | | | |
| B*0704 | 12 | | | | | | | | |
| B*0705 | 13 | 14 | | | | | | | |
| B*0706 | 13 | | | | | | | | |
| B*0707 | 15 | | | | | | | | |
| B*0708 | 16 | 17 | | | | | | | |
| B*0709 | 18 | | | | | | | | |
| B*0710 | 19 | | | | | | | | |

TABLE 7-continued

Allele-Probe List 1

| | | | | | | | | | |
|---|---|---|---|---|---|---|---|---|---|
| B*0711 | 20 | 18 | | | | | | | |
| B*0712 | 21 | 22 | 23 | 24 | | | | | |
| B*0713 | 25 | 26 | 27 | | | | | | |
| B*0714 | 28 | 21 | 29 | 30 | | | | | |
| B*0715 | 31 | 27 | | | | | | | |
| B*0716 | 11 | 32 | | | | | | | |
| B*0717 | 30 | 33 | | | | | | | |
| B*0718 | 28 | 22 | | | | | | | |
| B*0719 | 12 | 34 | 35 | 36 | | | | | |
| B*0720 | 37 | 38 | | | | | | | |
| B*0721 | 39 | | | | | | | | |
| B*0722 | 40 | | | | | | | | |
| B*0723 | 41 | | | | | | | | |
| B*0724 | 42 | | | | | | | | |
| B*0725 | 43 | 44 | | | | | | | |
| B*0726 | 45 | | | | | | | | |
| B*0727 | 46 | 32 | 47 | 48 | | | | | |
| B*0728 | 30 | 49 | | | | | | | |
| B*0729 | 50 | 51 | | | | | | | |
| B*0730 | 52 | | | | | | | | |
| B*0731 | 53 | 34 | | | | | | | |
| B*0801 | 50 | 54 | | | | | | | |
| B*0802 | 50 | 55 | 54 | | | | | | |
| B*0803 | 56 | 57 | 58 | 13 | 43 | 44 | 53 | 34 | 59 |
| B*0804 | 50 | 46 | 13 | 44 | 53 | 59 | | | |
| B*0805 | 60 | | | | | | | | |
| B*0806 | 50 | 16 | 20 | 13 | 53 | 59 | | | |
| B*0807 | 50 | 16 | 44 | 53 | 59 | | | | |
| B*0809 | 50 | 61 | 13 | 44 | 53 | 59 | | | |
| B*0810 | 50 | 62 | 63 | 13 | 44 | 53 | 59 | | |
| B*0811 | 50 | 16 | 13 | 44 | 59 | | | | |
| B*0812 | 50 | 15 | 13 | 44 | 53 | 59 | | | |
| B*0813 | 50 | 16 | 64 | 53 | 59 | | | | |
| B*0814 | 50 | 65 | 44 | 53 | 59 | | | | |
| B*0815 | 66 | 44 | 34 | 59 | | | | | |
| B*0816 | 67 | 44 | 59 | | | | | | |
| B*0817 | 50 | 68 | 20 | 69 | | | | | |
| B*1301 | 21 | 70 | 54 | | | | | | |
| B*1302 | 71 | 70 | 54 | | | | | | |
| B*1303 | 55 | 61 | 72 | 43 | 64 | 37 | 54 | | |
| B*1304 | 73 | 18 | 64 | 74 | | | | | |
| B*1306 | 70 | 34 | | | | | | | |
| B*1308 | 75 | | | | | | | | |
| B*1309 | 71 | 61 | 72 | 70 | | | | | |
| B*1310 | 33 | 70 | | | | | | | |
| B*1311 | 70 | 69 | | | | | | | |
| B*1401 | 76 | 77 | 78 | | | | | | |
| B*1402 | 79 | 76 | 77 | 78 | | | | | |
| B*1403 | 79 | 76 | 77 | | | | | | |
| B*1404 | 80 | | | | | | | | |
| B*1405 | 79 | 81 | 45 | 82 | 83 | | | | |
| B*140601 | 79 | 81 | 15 | 45 | 82 | 83 | | | |
| B*140602 | 79 | 81 | 84 | 45 | 82 | 83 | | | |
| B*15010101 | 85 | 86 | 87 | 68 | 32 | 88 | 89 | 54 | |
| B*150102 | 90 | 91 | 88 | 37 | 83 | | | | |
| B*150103 | 92 | | | | | | | | |
| B*150104 | 93 | 37 | | | | | | | |
| B*1502 | 85 | 46 | 22 | 30 | 33 | 45 | 89 | 54 | |
| B*1503 | 85 | 10 | 87 | 68 | 94 | 15 | 18 | 45 | 89 | 54 |
| B*1504 | 85 | 61 | 88 | 89 | 54 | | | | |
| B*1505 | 15 | 43 | 64 | 37 | 89 | 95 | | | |
| B*1506 | 96 | 45 | 95 | 54 | | | | | |
| B*1507 | 86 | 87 | 68 | 32 | 88 | 54 | | | |
| B*1508 | 85 | 16 | 32 | 88 | 89 | 54 | | | |
| B*1509 | 85 | 97 | 45 | 89 | 54 | | | | |
| B*1510 | 85 | 10 | 19 | 98 | 15 | 45 | 89 | 54 | |
| B*151101 | 85 | 86 | 32 | 88 | 89 | 54 | | | |
| B*151102 | 99 | | | | | | | | |
| B*1512 | 100 | | | | | | | | |
| B*1513 | 85 | 58 | 22 | 30 | 33 | 45 | 89 | 54 | |
| B*1514 | 85 | 38 | 89 | 54 | | | | | |
| B*1515 | 85 | 86 | 46 | 32 | 88 | 89 | 54 | | |
| B*1516 | 101 | 54 | | | | | | | |
| B*151701 | 102 | 65 | 89 | 95 | 54 | | | | |
| B*1518 | 85 | 10 | 19 | 98 | 15 | 18 | 45 | 89 | 54 |
| B*1519 | 103 | | | | | | | | |
| B*1520 | 85 | 104 | 54 | | | | | | |
| B*1521 | 85 | 19 | 22 | 30 | 33 | 45 | 89 | 54 | |

TABLE 7-continued

| Allele-Probe List 1 | | | | | | | | | | | | | | | |
|---|---|---|---|---|---|---|---|---|---|---|---|---|---|---|---|
| B*1523 | 85 | 19 | 98 | 58 | 15 | 18 | 45 | 89 | 54 | | | | | | |
| B*1524 | 57 | 58 | 15 | 18 | 91 | 88 | 37 | 83 | | | | | | | |
| B*1525 | 85 | 87 | 68 | 22 | 30 | 33 | 45 | 89 | 54 | | | | | | |
| B*1527 | 96 | 88 | 37 | | | | | | | | | | | | |
| B*1528 | 105 | | | | | | | | | | | | | | |
| B*1529 | 85 | 16 | 17 | 15 | 18 | 45 | 89 | | | | | | | | |
| B*1530 | 68 | 13 | 91 | 88 | 37 | | | | | | | | | | |
| B*1531 | 106 | 15 | 30 | 33 | 43 | 64 | 37 | 83 | | | | | | | |
| B*1532 | 107 | 88 | 37 | | | | | | | | | | | | |
| B*1533 | 108 | | | | | | | | | | | | | | |
| B*1534 | 68 | 109 | 18 | 91 | 88 | 37 | 83 | | | | | | | | |
| B*1535 | 110 | 111 | 18 | 91 | 88 | 37 | 83 | | | | | | | | |
| B*1536 | 112 | 30 | 33 | 45 | 42 | 37 | 113 | 83 | | | | | | | |
| B*1537 | 10 | 19 | 32 | 114 | 45 | 37 | 82 | | | | | | | | |
| B*1538 | 88 | 82 | 83 | | | | | | | | | | | | |
| B*1539 | 115 | 106 | 87 | 68 | 94 | 15 | 18 | 45 | 37 | 83 | | | | | |
| B*1540 | 115 | 106 | 87 | 68 | 94 | 15 | 18 | 45 | 83 | | | | | | |
| B*1542 | 68 | 32 | 71 | 61 | 73 | 72 | 34 | 83 | | | | | | | |
| B*1543 | 47 | 88 | 37 | 83 | | | | | | | | | | | |
| B*1544 | 19 | 33 | 91 | 45 | 34 | 83 | | | | | | | | | |
| B*1545 | 116 | 117 | 86 | 87 | 68 | 32 | 91 | 88 | 37 | 83 | | | | | |
| B*1546 | 85 | 115 | 118 | 119 | 87 | 68 | 32 | 18 | 88 | 37 | 83 | | | | |
| B*1547 | 10 | 87 | 68 | 94 | 32 | 15 | 18 | 114 | 91 | 83 | | | | | |
| B*1548 | 68 | 13 | 120 | 121 | 122 | 83 | | | | | | | | | |
| B*1549 | 123 | | | | | | | | | | | | | | |
| B*1550 | 18 | 88 | 34 | 83 | | | | | | | | | | | |
| B*1551 | 19 | 18 | 43 | 44 | 37 | 35 | 113 | 83 | | | | | | | |
| B*1552 | 85 | 19 | 15 | 43 | 64 | 83 | | | | | | | | | |
| B*1553 | 85 | 124 | 118 | 119 | 87 | 68 | 32 | 18 | 88 | 37 | 83 | | | | |
| B*1554 | 85 | 10 | 87 | 68 | 32 | 88 | 89 | 54 | | | | | | | |
| B*1555 | 85 | 43 | 64 | 89 | 54 | | | | | | | | | | |
| B*1556 | 87 | 125 | 32 | 15 | 18 | 91 | 88 | 37 | 83 | | | | | | |
| B*1557 | 126 | 127 | 37 | 113 | 83 | | | | | | | | | | |
| B*1558 | 85 | 128 | 88 | 37 | 83 | | | | | | | | | | |
| B*1560 | 129 | | | | | | | | | | | | | | |
| B*1561 | 10 | 87 | 68 | 94 | 15 | 18 | 114 | 45 | 37 | 83 | | | | | |
| B*1562 | 10 | 87 | 68 | 94 | 32 | 21 | 22 | 23 | 24 | 18 | 114 | 91 | 45 | 37 | 113 | 83 |
| B*1563 | 116 | 117 | 86 | 87 | 68 | 32 | 15 | 91 | 88 | 37 | 83 | | | | |
| B*1564 | 10 | 46 | 94 | 32 | 15 | 18 | 114 | 45 | 37 | 83 | | | | | |
| B*1565 | 116 | 115 | 106 | 87 | 68 | 94 | 32 | 15 | 18 | 91 | 37 | 83 | | | |
| B*1566 | 85 | 130 | 32 | 88 | 89 | 54 | | | | | | | | | |
| B*1567 | 131 | | | | | | | | | | | | | | |
| B*1568 | 87 | 68 | 32 | 88 | 89 | | | | | | | | | | |
| B*1569 | 68 | 18 | 45 | 120 | 132 | 83 | | | | | | | | | |
| B*1570 | 116 | 117 | 86 | 87 | 68 | 94 | 15 | 18 | 91 | 88 | 37 | 83 | | | |
| B*1571 | 133 | 86 | 87 | 68 | 32 | 15 | 88 | 89 | | | | | | | |
| B*1572 | 10 | 19 | 18 | 45 | 37 | 134 | 89 | | | | | | | | |
| B*1573 | 72 | 88 | 37 | 83 | | | | | | | | | | | |
| B*1574 | 135 | | | | | | | | | | | | | | |
| B*1575 | 136 | | | | | | | | | | | | | | |
| B*180101 | 137 | 32 | 15 | 54 | | | | | | | | | | | |
| B*180102 | 138 | | | | | | | | | | | | | | |
| B*1802 | 137 | 139 | 54 | | | | | | | | | | | | |
| B*1803 | 137 | 15 | 54 | | | | | | | | | | | | |
| B*1804 | 140 | 137 | 46 | 32 | 15 | 43 | 64 | 82 | | | | | | | |
| B*1805 | 141 | | | | | | | | | | | | | | |
| B*1806 | 126 | 82 | 95 | 54 | | | | | | | | | | | |
| B*1807 | 137 | 16 | 32 | 15 | 43 | 64 | 82 | | | | | | | | |
| B*1808 | 142 | | | | | | | | | | | | | | |
| B*1809 | 137 | 55 | 15 | 43 | 64 | 82 | | | | | | | | | |
| B*1810 | 133 | 137 | 46 | 32 | 15 | 43 | 64 | | | | | | | | |
| B*1811 | 133 | 137 | 46 | 32 | 15 | 43 | 64 | 34 | | | | | | | |
| B*1812 | 137 | 87 | 68 | 32 | 15 | 43 | 64 | 82 | | | | | | | |
| B*1813 | 133 | 137 | 46 | 32 | 15 | 43 | 82 | | | | | | | | |
| B*1814 | 133 | 137 | 46 | 32 | 43 | 64 | 82 | | | | | | | | |
| B*1815 | 133 | 137 | 46 | 32 | 15 | 45 | 82 | | | | | | | | |
| B*1818 | 107 | 64 | 82 | | | | | | | | | | | | |
| B*2701 | 130 | 144 | 145 | 55 | 146 | 65 | 43 | 64 | 83 | | | | | | |
| B*2702 | 57 | 58 | 146 | 65 | 43 | 54 | | | | | | | | | |
| B*2703 | 147 | | | | | | | | | | | | | | |
| B*2704 | 65 | 148 | | | | | | | | | | | | | |
| B*270502 | 130 | 149 | 146 | 65 | 114 | 64 | 54 | | | | | | | | |
| B*270503 | 150 | | | | | | | | | | | | | | |
| B*270504 | 151 | 130 | 149 | 146 | 139 | 65 | 114 | 43 | 64 | 83 | | | | | |
| B*270505 | 152 | | | | | | | | | | | | | | |
| B*270506 | 153 | 114 | | | | | | | | | | | | | |
| B*2706 | 148 | | | | | | | | | | | | | | |
| B*2707 | 149 | 48 | 13 | 64 | 54 | | | | | | | | | | |

TABLE 7-continued

Allele-Probe List 1

| | | | | | | | | | | | | | | | | |
|---|---|---|---|---|---|---|---|---|---|---|---|---|---|---|---|---|
| B*2708 | 130 | 146 | 65 | 43 | 54 | | | | | | | | | | | |
| B*2709 | 154 | | | | | | | | | | | | | | | |
| B*2710 | 130 | 149 | 146 | 139 | 65 | 114 | 45 | 83 | | | | | | | | |
| B*2711 | 155 | 48 | 13 | 43 | 64 | 54 | | | | | | | | | | |
| B*2712 | 130 | 98 | 146 | 65 | 43 | 54 | | | | | | | | | | |
| B*2713 | 130 | 149 | 146 | 65 | 114 | 64 | 54 | | | | | | | | | |
| B*2714 | 149 | 73 | 65 | 114 | 43 | 64 | 83 | | | | | | | | | |
| B*2715 | 146 | 65 | 34 | 83 | | | | | | | | | | | | |
| B*2716 | 130 | 98 | 149 | 146 | 139 | 65 | 114 | 43 | 64 | 83 | | | | | | |
| B*2717 | 156 | | | | | | | | | | | | | | | |
| B*2718 | 133 | 124 | 68 | 94 | 32 | 146 | 65 | 114 | 45 | 83 | | | | | | |
| B*2719 | 149 | 21 | 29 | 65 | 114 | 43 | 64 | 83 | | | | | | | | |
| B*2720 | 146 | 13 | 45 | 83 | | | | | | | | | | | | |
| B*2721 | 130 | 48 | 15 | 30 | 114 | 45 | 83 | | | | | | | | | |
| B*2723 | 16 | 17 | 32 | 157 | 48 | 146 | 65 | 43 | 64 | 83 | | | | | | |
| B*2724 | 48 | 158 | 83 | | | | | | | | | | | | | |
| B*2725 | 146 | 37 | 83 | | | | | | | | | | | | | |
| B*350101 | 16 | 17 | 21 | 22 | 18 | 114 | 43 | 64 | 37 | 104 | 54 | | | | | |
| B*350102 | 159 | | | | | | | | | | | | | | | |
| B*3502 | 160 | | | | | | | | | | | | | | | |
| B*3503 | 161 | 114 | 43 | 64 | 37 | 104 | 54 | | | | | | | | | |
| B*3504 | 24 | 13 | 114 | 43 | 64 | 37 | 104 | 54 | | | | | | | | |
| B*3505 | 16 | 17 | 18 | 114 | 43 | 64 | 37 | 104 | 54 | | | | | | | |
| B*3506 | 13 | 128 | 114 | 43 | 64 | 37 | 104 | 54 | | | | | | | | |
| B*3507 | 162 | | | | | | | | | | | | | | | |
| B*3508 | 16 | 17 | 21 | 22 | 18 | 114 | 43 | 37 | 104 | 54 | | | | | | |
| B*350901 | 24 | 13 | 43 | 64 | 37 | 104 | 54 | | | | | | | | | |
| B*350902 | 16 | 24 | 13 | 43 | 64 | 37 | 113 | 83 | | | | | | | | |
| B*3510 | 87 | 125 | 17 | 32 | 21 | 22 | 23 | 24 | 18 | 114 | 163 | 43 | 64 | 37 | | |
| B*3511 | 16 | 17 | 21 | 22 | 18 | 114 | 45 | 37 | 104 | 54 | | | | | | |
| B*3512 | 13 | 114 | 43 | 64 | 37 | 104 | 54 | | | | | | | | | |
| B*3513 | 87 | 125 | 32 | 24 | 161 | 114 | 163 | 43 | 64 | 37 | 113 | 83 | | | | |
| B*3514 | 163 | 88 | 37 | 83 | | | | | | | | | | | | |
| B*3515 | 16 | 17 | 21 | 22 | 18 | 114 | 43 | 64 | 104 | 54 | | | | | | |
| B*3516 | 87 | 125 | 17 | 32 | 21 | 164 | 18 | 114 | 163 | 43 | 64 | 37 | 113 | 83 | | |
| B*3517 | 165 | 166 | 16 | 17 | 32 | 21 | 164 | 18 | 114 | 163 | 43 | 64 | 37 | 113 | 83 | |
| B*3518 | 16 | 17 | 21 | 24 | 13 | 43 | 37 | 113 | 83 | | | | | | | |
| B*3519 | 119 | 16 | 17 | 32 | 21 | 22 | 23 | 24 | 18 | 114 | 163 | 43 | 64 | 37 | 113 | 83 |
| B*3520 | 167 | 166 | 46 | 94 | 32 | 21 | 22 | 23 | 24 | 18 | 114 | 163 | 43 | 64 | 37 | 113 | 83 |
| B*3521 | 18 | 114 | 163 | 45 | 37 | 82 | | | | | | | | | | |
| B*3522 | 167 | 16 | 13 | 114 | 163 | 43 | 64 | 37 | 83 | | | | | | | |
| B*3523 | 168 | 18 | 43 | 64 | 37 | 83 | | | | | | | | | | |
| B*3524 | 18 | 43 | 64 | 37 | 82 | | | | | | | | | | | |
| B*3525 | 10 | 16 | 17 | 32 | 21 | 22 | 23 | 24 | 18 | 114 | 163 | 43 | 64 | 37 | 113 | 83 |
| B*3526 | 81 | 42 | 37 | 83 | | | | | | | | | | | | |
| B*3527 | 16 | 17 | 169 | 21 | 22 | 23 | 24 | 18 | 114 | 163 | 43 | 64 | 37 | 113 | 83 | |
| B*3528 | 167 | 166 | 87 | 68 | 94 | 32 | 21 | 22 | 23 | 24 | 18 | 114 | 163 | 43 | 64 | 37 | 113 83 |
| B*3529 | 165 | 166 | 16 | 17 | 21 | 22 | 23 | 24 | 18 | 114 | 163 | 43 | 64 | 37 | 113 | 83 |
| B*3530 | 165 | 166 | 16 | 17 | 32 | 21 | 170 | 24 | 18 | 114 | 163 | 43 | 64 | 37 | 113 | 83 |
| B*3531 | 151 | 165 | 16 | 17 | 32 | 13 | 43 | 64 | 54 | | | | | | | |
| B*3532 | 165 | 166 | 16 | 17 | 32 | 15 | 164 | 18 | 114 | 163 | 43 | 64 | 37 | 113 | 83 | |
| B*3533 | 16 | 32 | 24 | 161 | 114 | 163 | 43 | 64 | 113 | 83 | | | | | | |
| B*3534 | 165 | 166 | 16 | 17 | 32 | 21 | 22 | 23 | 24 | 114 | 163 | 43 | 64 | 37 | 113 | 83 |
| B*3535 | 18 | 43 | 64 | 120 | 132 | 83 | | | | | | | | | | |
| B*3536 | 171 | | | | | | | | | | | | | | | |
| B*3537 | 71 | 61 | 73 | 24 | 18 | 114 | 163 | 43 | 64 | 37 | 113 | 83 | | | | |
| B*3538 | 21 | 161 | 163 | 43 | 44 | 37 | 35 | 113 | 83 | | | | | | | |
| B*3539 | 165 | 166 | 16 | 17 | 32 | 28 | 29 | 114 | 163 | 43 | 64 | 37 | 83 | | | |
| B*3541 | 172 | | | | | | | | | | | | | | | |
| B*3542 | 155 | 104 | 95 | 54 | | | | | | | | | | | | |
| B*3543 | 167 | 16 | 32 | 15 | 88 | 54 | | | | | | | | | | |
| B*3544 | 16 | 13 | 91 | 88 | 37 | 83 | | | | | | | | | | |
| B*3545 | 21 | 24 | 18 | 163 | 43 | 37 | 38 | 83 | | | | | | | | |
| B*3701 | 173 | 54 | | | | | | | | | | | | | | |
| B*3702 | 32 | 47 | 146 | 65 | 114 | 64 | 54 | | | | | | | | | |
| B*3704 | 173 | 82 | 54 | | | | | | | | | | | | | |
| B*3705 | 173 | 44 | 34 | | | | | | | | | | | | | |
| B*3801 | 56 | 58 | 15 | 64 | 120 | 77 | 78 | | | | | | | | | |
| B*380201 | 144 | 55 | 15 | 64 | 120 | 77 | 78 | | | | | | | | | |
| B*380202 | 174 | | | | | | | | | | | | | | | |
| B*3803 | 81 | 68 | 175 | 55 | 15 | 13 | 128 | 64 | 120 | 132 | 83 | | | | | |
| B*3804 | 87 | 169 | 144 | 55 | 15 | 13 | 128 | 43 | 64 | 120 | 132 | 83 | | | | |
| B*3805 | 79 | 56 | 58 | 15 | 64 | 120 | 77 | | | | | | | | | |
| B*3806 | 16 | 56 | 58 | 15 | 13 | 128 | 43 | 64 | 120 | 132 | 83 | | | | | |
| B*3807 | 176 | | | | | | | | | | | | | | | |
| B*3808 | 81 | 177 | 178 | 83 | | | | | | | | | | | | |
| B*3809 | 179 | | | | | | | | | | | | | | | |

TABLE 7-continued

Allele-Probe List 1

| | | | | | | | | | | | | |
|---|---|---|---|---|---|---|---|---|---|---|---|---|
| B*390101 | 19 | 98 | 15 | 64 | 120 | 77 | 78 | | | | | |
| B*390103 | 19 | 77 | 54 | | | | | | | | | |
| B*390104 | 180 | | | | | | | | | | | |
| B*390201 | 68 | 77 | 54 | | | | | | | | | |
| B*390202 | 68 | 94 | 15 | 64 | 120 | 77 | 78 | | | | | |
| B*3903 | 19 | 98 | 64 | 120 | 77 | 78 | | | | | | |
| B*3904 | 116 | 19 | 98 | 15 | 64 | 120 | 77 | 78 | | | | |
| B*3905 | 32 | 15 | 64 | 120 | 77 | 78 | | | | | | |
| B*390601 | 71 | 181 | 64 | 120 | 77 | 78 | | | | | | |
| B*390602 | 71 | 61 | 64 | 120 | 77 | 78 | | | | | | |
| B*3907 | 81 | 18 | 64 | 120 | 132 | | | | | | | |
| B*3908 | 68 | 32 | 15 | 182 | 77 | 78 | | | | | | |
| B*3909 | 107 | 77 | 78 | | | | | | | | | |
| B*3910 | 11 | 15 | 64 | 120 | 77 | 78 | | | | | | |
| B*3911 | 81 | 19 | 32 | 15 | 182 | 89 | | | | | | |
| B*3912 | 183 | 113 | | | | | | | | | | |
| B*3913 | 68 | 32 | 15 | 13 | 128 | 43 | 64 | 120 | 132 | 83 | | |
| B*3914 | 81 | 19 | 98 | 13 | 64 | 120 | 132 | 83 | | | | |
| B*3915 | 81 | 19 | 98 | 15 | 161 | 64 | 120 | 132 | 83 | | | |
| B*3916 | 184 | | | | | | | | | | | |
| B*3917 | 185 | 120 | 132 | 83 | | | | | | | | |
| B*3918 | 81 | 88 | 186 | 132 | 83 | | | | | | | |
| B*3919 | 166 | 19 | 98 | 15 | 13 | 128 | 43 | 64 | 120 | 132 | 83 | |
| B*3920 | 169 | 15 | 13 | 128 | 43 | 64 | 120 | 132 | 83 | | | |
| B*3922 | 81 | 187 | 130 | 98 | 15 | 13 | 128 | 64 | 120 | 132 | 83 | |
| B*3923 | 188 | | | | | | | | | | | |
| B*3924 | 189 | | | | | | | | | | | |
| B*3926 | 190 | | | | | | | | | | | |
| B*3927 | 98 | 66 | 120 | 132 | 113 | 83 | | | | | | |
| B*400101 | 191 | | | | | | | | | | | |
| B*400102 | 133 | 124 | 118 | 192 | 119 | 87 | 68 | 32 | 15 | 13 | 193 | 194 |
| B*400103 | 133 | 124 | 118 | 192 | 87 | 68 | 32 | 15 | 13 | 193 | 194 | |
| B*4002 | 155 | 68 | 32 | 13 | 43 | 64 | 54 | | | | | |
| B*4003 | 155 | 87 | 68 | 32 | 18 | 43 | 64 | 54 | | | | |
| B*4004 | 155 | 23 | 13 | 43 | 64 | 54 | | | | | | |
| B*4005 | 155 | 13 | 45 | 37 | 54 | | | | | | | |
| B*400601 | 155 | 71 | 61 | 13 | 43 | 64 | 54 | | | | | |
| B*4007 | 125 | 32 | 15 | 13 | 193 | 194 | | | | | | |
| B*4008 | 155 | 16 | 32 | 13 | 43 | 64 | 54 | | | | | |
| B*4009 | 133 | 124 | 118 | 30 | 43 | 64 | 35 | 113 | 83 | | | |
| B*4010 | 115 | 118 | 192 | 119 | 87 | 68 | 32 | 15 | 13 | 193 | 194 | |
| B*4011 | 133 | 124 | 118 | 15 | 13 | 43 | 64 | 35 | 113 | 83 | | |
| B*4012 | 85 | 10 | 119 | 87 | 68 | 32 | 15 | 13 | 193 | 194 | | |
| B*4013 | 155 | 57 | 58 | 13 | 43 | 64 | | | | | | |
| B*401401 | 133 | 124 | 118 | 13 | 163 | 43 | 64 | | | | | |
| B*401402 | 133 | 124 | 118 | 13 | 196 | 43 | 64 | | | | | |
| B*4015 | 197 | | | | | | | | | | | |
| B*4016 | 133 | 198 | 124 | 118 | 119 | 87 | 68 | 32 | 13 | | | |
| B*4018 | 133 | 124 | 118 | 68 | 43 | 64 | 35 | 113 | 83 | | | |
| B*4019 | 118 | 68 | 94 | 56 | 13 | 43 | 64 | 113 | | | | |
| B*4020 | 155 | 87 | 68 | 32 | 15 | 18 | 43 | 64 | | | | |
| B*4021 | 117 | 86 | 87 | 68 | 32 | 15 | 13 | 193 | 194 | | | |
| B*4023 | 133 | 124 | 118 | 192 | 119 | 87 | 68 | 32 | 15 | 13 | 158 | |
| B*4024 | 133 | 118 | 119 | 87 | 68 | 94 | 32 | 170 | 24 | 43 | 64 | 113 | 83 |
| B*4025 | 133 | 124 | 118 | 192 | 119 | 46 | 32 | 15 | 13 | 193 | 194 | |
| B*4026 | 118 | 87 | 68 | 32 | 97 | 45 | 37 | | | | | |
| B*4027 | 199 | | | | | | | | | | | |
| B*4028 | 23 | 97 | 45 | 37 | 82 | | | | | | | |
| B*4029 | 200 | 13 | | | | | | | | | | |
| B*4030 | 201 | 193 | 64 | | | | | | | | | |
| B*4031 | 133 | 124 | 118 | 192 | 119 | 87 | 68 | 32 | 193 | 194 | | |
| B*4032 | 133 | 198 | 124 | 118 | 119 | 87 | 68 | 32 | | | | |
| B*4033 | 133 | 124 | 118 | 192 | 119 | 87 | 68 | 32 | 15 | 193 | 194 | |
| B*4034 | 202 | | | | | | | | | | | |
| B*4035 | 133 | 124 | 118 | 13 | 114 | 43 | 64 | 35 | 113 | 83 | | |
| B*4036 | 15 | 128 | 193 | 194 | | | | | | | | |
| B*4037 | 133 | 124 | 118 | 68 | 169 | 13 | 43 | 64 | 35 | 113 | 83 | |
| B*4038 | 203 | 193 | 194 | | | | | | | | | |
| B*4039 | 155 | 13 | 64 | 34 | 69 | | | | | | | |
| B*4040 | 124 | 118 | 68 | 13 | 43 | 64 | 35 | 113 | 83 | | | |
| B*4042 | 30 | 193 | 194 | | | | | | | | | |
| B*4043 | 133 | 124 | 118 | 192 | 119 | 87 | 68 | 15 | 13 | 193 | 194 | |
| B*4044 | 124 | 118 | 68 | 32 | 71 | 61 | 43 | 64 | 113 | | | |
| B*4101 | 204 | 205 | 44 | 34 | 54 | | | | | | | |
| B*4102 | 119 | 32 | 44 | 34 | 54 | | | | | | | |
| B*4103 | 183 | 44 | | | | | | | | | | |
| B*4104 | 24 | 43 | 44 | 53 | 34 | 59 | | | | | | |
| B*4105 | 206 | | | | | | | | | | | |

TABLE 7-continued

Allele-Probe List 1

| | | | | | | | | | | | | |
|---|---|---|---|---|---|---|---|---|---|---|---|---|
| B*4106 | 204 | 44 | 34 | 207 | 208 | | | | | | | |
| B*4201 | 44 | 34 | 54 | | | | | | | | | |
| B*4202 | 133 | 13 | 43 | 44 | 53 | 34 | 59 | | | | | |
| B*4204 | 71 | 61 | 13 | 43 | 44 | 53 | 34 | 59 | | | | |
| B*440201 | 118 | 55 | 44 | 37 | 209 | 54 | | | | | | |
| B*440202 | 210 | 55 | 44 | 37 | 209 | | | | | | | |
| B*440203 | 211 | | | | | | | | | | | |
| B*440301 | 118 | 64 | 37 | 209 | 54 | | | | | | | |
| B*440302 | 118 | 22 | 64 | 37 | 209 | 54 | | | | | | |
| B*4404 | 34 | 209 | 54 | | | | | | | | | |
| B*4405 | 87 | 144 | 212 | 55 | 21 | 30 | 44 | 37 | 38 | 83 | | |
| B*4406 | 213 | 44 | 38 | | | | | | | | | |
| B*4407 | 22 | 64 | 37 | 209 | 54 | | | | | | | |
| B*4408 | 117 | 55 | 44 | 37 | 209 | 54 | | | | | | |
| B*4409 | 118 | 44 | 37 | 209 | 54 | | | | | | | |
| B*4410 | 168 | 64 | 38 | 83 | | | | | | | | |
| B*4411 | 116 | 118 | 119 | 87 | 144 | 214 | 21 | 30 | 49 | 44 | 37 | 38 | 83 |
| B*4412 | 116 | 118 | 119 | 144 | 212 | 55 | 21 | 30 | 49 | 44 | 37 | 38 | 83 |
| B*4413 | 215 | | | | | | | | | | | |
| B*4414 | 13 | 216 | 44 | 37 | 38 | 83 | | | | | | |
| B*4415 | 175 | 55 | 30 | 185 | 44 | 38 | 83 | | | | | |
| B*4416 | 116 | 118 | 119 | 87 | 112 | 212 | 21 | 30 | 49 | 44 | 113 | 83 |
| B*4417 | 18 | 44 | 37 | 38 | 83 | | | | | | | |
| B*4418 | 56 | 58 | 30 | 185 | 44 | 38 | 83 | | | | | |
| B*4420 | 61 | 30 | 49 | 44 | 37 | 38 | 83 | | | | | |
| B*4421 | 116 | 118 | 119 | 87 | 144 | 212 | 55 | 21 | 30 | 49 | 44 | 217 | 83 |
| B*4422 | 118 | 119 | 87 | 144 | 212 | 55 | 21 | 30 | 49 | 44 | 37 | 38 | 83 |
| B*4424 | 218 | 38 | 83 | | | | | | | | | |
| B*4425 | 68 | 56 | 219 | 58 | 21 | 30 | 44 | 37 | 38 | 83 | | |
| B*4426 | 220 | | | | | | | | | | | |
| B*4427 | 118 | 55 | 49 | 44 | 37 | 38 | 89 | | | | | |
| B*4428 | 118 | 21 | 22 | 30 | 49 | 163 | 43 | 37 | 38 | 83 | | |
| B*4429 | 120 | 38 | 83 | | | | | | | | | |
| B*4430 | 221 | | | | | | | | | | | |
| B*4431 | 193 | 217 | | | | | | | | | | |
| B*4432 | 200 | 38 | | | | | | | | | | |
| B*4433 | 222 | | | | | | | | | | | |
| B*4501 | 30 | 185 | 44 | 38 | 89 | 95 | 54 | | | | | |
| B*4502 | 32 | 30 | 223 | 44 | 37 | 38 | 83 | | | | | |
| B*4503 | 224 | | | | | | | | | | | |
| B*4504 | 30 | 185 | 44 | 89 | 95 | 54 | | | | | | |
| B*4505 | 225 | | | | | | | | | | | |
| B*4506 | 30 | 185 | 44 | 38 | 83 | | | | | | | |
| B*4601 | 226 | 54 | | | | | | | | | | |
| B*4602 | 227 | | | | | | | | | | | |
| B*470101 | 228 | | | | | | | | | | | |
| B*4702 | 96 | 43 | 64 | 69 | | | | | | | | |
| B*4703 | 229 | 96 | 65 | 43 | 64 | 83 | | | | | | |
| B*4704 | 94 | 144 | 145 | 55 | 146 | 65 | 43 | 64 | 83 | | | |
| B*4801 | 32 | 230 | | | | | | | | | | |
| B*4802 | 68 | 94 | 21 | 22 | 18 | 114 | 43 | 64 | 37 | 104 | 54 | |
| B*4803 | 87 | 68 | 32 | 15 | 13 | 193 | 194 | | | | | |
| B*4804 | 83 | 230 | | | | | | | | | | |
| B*4805 | 231 | 87 | 68 | 32 | 13 | | | | | | | |
| B*4806 | 16 | 32 | 13 | 193 | 194 | | | | | | | |
| B*4807 | 128 | 193 | 194 | | | | | | | | | |
| B*4901 | 58 | 185 | 45 | 89 | 95 | 54 | | | | | | |
| B*4902 | 144 | 55 | 185 | 45 | 89 | | | | | | | |
| B*4903 | 165 | 56 | 58 | 23 | 30 | 185 | 45 | 37 | 83 | | | |
| B*5001 | 185 | 45 | 89 | 95 | 54 | | | | | | | |
| B*5002 | 185 | 45 | 38 | 89 | 95 | 54 | | | | | | |
| B*5004 | 118 | 30 | 185 | 45 | 37 | 83 | | | | | | |
| B*510101 | 213 | 16 | 58 | 71 | 45 | 82 | 104 | 54 | | | | |
| B*510102 | 16 | 58 | 71 | 45 | 82 | 104 | 54 | | | | | |
| B*510103 | 213 | 16 | 58 | 71 | 61 | 97 | 114 | 45 | 37 | 82 | | |
| B*510104 | 213 | 166 | 16 | 58 | 71 | 61 | 13 | 114 | 45 | 37 | 82 | |
| B*510105 | 134 | 104 | 54 | | | | | | | | | |
| B*510201 | 213 | 16 | 58 | 71 | 97 | 114 | 45 | 37 | 104 | 54 | | |
| B*510202 | 16 | 58 | 71 | 97 | 114 | 45 | 37 | 104 | 54 | | | |
| B*5103 | 233 | 104 | | | | | | | | | | |
| B*5104 | 21 | 45 | 82 | 104 | 54 | | | | | | | |
| B*5105 | 58 | 97 | 114 | 43 | 37 | 104 | | | | | | |
| B*5106 | 213 | 166 | 16 | 58 | 97 | 114 | 45 | 37 | 82 | | | |
| B*5107 | 213 | 167 | 46 | 58 | 71 | 61 | 97 | 114 | 45 | 37 | 82 | |
| B*5108 | 44 | 82 | 104 | 54 | | | | | | | | |
| B*5109 | 213 | 43 | 64 | 37 | 82 | | | | | | | |
| B*5110 | 58 | 71 | 61 | 13 | 43 | 64 | 104 | | | | | |
| B*5112 | 234 | | | | | | | | | | | |

TABLE 7-continued

Allele-Probe List 1

| Allele | | | | | | | | | | | | | | | |
|---|---|---|---|---|---|---|---|---|---|---|---|---|---|---|---|
| B*511301 | 213 | 128 | 114 | 45 | 37 | 82 | | | | | | | | | |
| B*511302 | 213 | 128 | 235 | 114 | 45 | 37 | 82 | | | | | | | | |
| B*5114 | 236 | | | | | | | | | | | | | | |
| B*5115 | 56 | 58 | 71 | 61 | 73 | 72 | 43 | 64 | 37 | 83 | | | | | |
| B*5116 | 213 | 166 | 16 | 58 | 71 | 61 | 97 | 114 | 45 | 82 | | | | | |
| B*5117 | 237 | | | | | | | | | | | | | | |
| B*5118 | 238 | | | | | | | | | | | | | | |
| B*5119 | 213 | 120 | 122 | 82 | | | | | | | | | | | |
| B*5120 | 213 | 44 | 37 | 82 | | | | | | | | | | | |
| B*5121 | 213 | 97 | 34 | 82 | | | | | | | | | | | |
| B*5122 | 213 | 19 | 58 | 71 | 61 | 97 | 114 | 45 | 37 | 82 | | | | | |
| B*5123 | 213 | 45 | 38 | | | | | | | | | | | | |
| B*5124 | 213 | 166 | 16 | 58 | 71 | 61 | 13 | 45 | 37 | 82 | | | | | |
| B*5126 | 239 | | | | | | | | | | | | | | |
| B*5128 | 240 | | | | | | | | | | | | | | |
| B*5129 | 213 | 16 | 58 | 71 | 82 | 104 | | | | | | | | | |
| B*5130 | 104 | 241 | | | | | | | | | | | | | |
| B*5131 | 213 | 97 | 43 | 64 | 82 | | | | | | | | | | |
| B*5132 | 242 | | | | | | | | | | | | | | |
| B*5133 | 213 | 166 | 16 | 58 | 71 | 61 | 97 | 114 | 45 | 37 | 82 | | | | |
| B*5134 | 213 | 166 | 16 | 58 | 71 | 61 | 97 | 114 | 163 | 45 | | | | | |
| B*520101 | 68 | 58 | 71 | 45 | 82 | 104 | 54 | | | | | | | | |
| B*520102 | 213 | 68 | 58 | 71 | 45 | 82 | 104 | 54 | | | | | | | |
| B*520103 | 167 | 87 | 68 | 58 | 71 | 61 | 97 | 45 | 37 | 82 | | | | | |
| B*520104 | 243 | | | | | | | | | | | | | | |
| B*5202 | 213 | 106 | 87 | 68 | 58 | 71 | 61 | 97 | 114 | 45 | 37 | 82 | | | |
| B*5203 | 213 | 68 | 43 | 64 | 37 | | | | | | | | | | |
| B*5204 | 244 | | | | | | | | | | | | | | |
| B*5205 | 245 | | | | | | | | | | | | | | |
| B*5301 | 17 | 58 | 21 | 22 | 18 | 114 | 43 | 64 | 37 | 104 | 54 | | | | |
| B*5302 | 58 | 18 | 43 | 64 | 37 | 82 | | | | | | | | | |
| B*5303 | 47 | 64 | 37 | 83 | | | | | | | | | | | |
| B*5304 | 56 | 58 | 24 | 161 | 114 | 163 | 43 | 64 | 37 | 113 | 83 | | | | |
| B*5305 | 17 | 246 | 247 | 58 | 21 | 22 | 23 | 24 | 18 | 114 | 163 | 43 | 64 | 37 | 113 | 83 |
| B*5306 | 213 | 18 | 114 | 45 | 37 | 82 | | | | | | | | | |
| B*5307 | 173 | 64 | 37 | | | | | | | | | | | | |
| B*5308 | 17 | 169 | 56 | 57 | 58 | 21 | 22 | 23 | 24 | 18 | 114 | 163 | 45 | 37 | 113 | 83 |
| B*5309 | 112 | 18 | 163 | 43 | 64 | 42 | 37 | 113 | 83 | | | | | | |
| B*5401 | 93 | 54 | | | | | | | | | | | | | |
| B*5402 | 133 | 93 | 34 | | | | | | | | | | | | |
| B*5501 | 72 | 34 | 95 | 54 | | | | | | | | | | | |
| B*5502 | 72 | 43 | 34 | 95 | 54 | | | | | | | | | | |
| B*5503 | 248 | 72 | 34 | 113 | 83 | | | | | | | | | | |
| B*5504 | 116 | 115 | 10 | 13 | 249 | 43 | 64 | 34 | 35 | 113 | 83 | | | | |
| B*5505 | 250 | | | | | | | | | | | | | | |
| B*5507 | 116 | 251 | 72 | 83 | | | | | | | | | | | |
| B*5508 | 115 | 10 | 15 | 13 | 249 | 43 | 64 | 37 | 83 | | | | | | |
| B*5509 | 116 | 115 | 10 | 71 | 61 | 73 | 72 | 163 | 83 | | | | | | |
| B*5510 | 71 | 61 | 73 | 72 | 43 | 34 | 83 | | | | | | | | |
| B*5511 | 252 | 34 | 83 | | | | | | | | | | | | |
| B*5512 | 20 | 72 | 43 | 34 | 95 | 54 | | | | | | | | | |
| B*5601 | 61 | 72 | 43 | 64 | 37 | 95 | 54 | | | | | | | | |
| B*5602 | 72 | 43 | 64 | 37 | 95 | 54 | | | | | | | | | |
| B*5603 | 253 | 254 | 115 | 15 | 88 | 54 | | | | | | | | | |
| B*5604 | 115 | 10 | 72 | 43 | 64 | 37 | 83 | | | | | | | | |
| B*5605 | 213 | 10 | 71 | 61 | 97 | 114 | 45 | 37 | 82 | | | | | | |
| B*5606 | 213 | 167 | 166 | 71 | 61 | 97 | 114 | 45 | 37 | 82 | | | | | |
| B*5607 | 10 | 144 | 55 | 71 | 61 | 73 | 72 | 43 | 64 | 37 | 83 | | | | |
| B*5608 | 255 | 64 | 37 | 83 | | | | | | | | | | | |
| B*5609 | 115 | 10 | 21 | 22 | 23 | 24 | 18 | 114 | 163 | 43 | 64 | 37 | 113 | 83 | |
| B*5610 | 116 | 115 | 10 | 109 | 72 | 43 | 34 | 83 | | | | | | | |
| B*5611 | 253 | 24 | 161 | 163 | 43 | 64 | 37 | 69 | | | | | | | |
| B*570101 | 256 | 18 | 64 | 74 | | | | | | | | | | | |
| B*570102 | 257 | | | | | | | | | | | | | | |
| B*5702 | 13 | 74 | | | | | | | | | | | | | |
| B*570301 | 13 | 64 | 74 | | | | | | | | | | | | |
| B*570302 | 258 | | | | | | | | | | | | | | |
| B*5704 | 201 | 49 | 43 | 83 | | | | | | | | | | | |
| B*5705 | 259 | 30 | 260 | 43 | 37 | | | | | | | | | | |
| B*5706 | 261 | | | | | | | | | | | | | | |
| B*5707 | 201 | 38 | 83 | | | | | | | | | | | | |
| B*5708 | 262 | | | | | | | | | | | | | | |
| B*5709 | 201 | 12 | 83 | | | | | | | | | | | | |
| B*5801 | 259 | 21 | 95 | 54 | | | | | | | | | | | |
| B*5802 | 76 | 54 | | | | | | | | | | | | | |
| B*5804 | 263 | | | | | | | | | | | | | | |
| B*5805 | 264 | | | | | | | | | | | | | | |
| B*5806 | 76 | 37 | | | | | | | | | | | | | |

TABLE 7-continued

Allele-Probe List 1

| | | | | | | | | | | |
|---|---|---|---|---|---|---|---|---|---|---|
| B*5807 | 76 | 38 | | | | | | | | |
| B*5901 | 58 | 72 | 43 | 34 | 95 | 54 | | | | |
| B*670101 | 81 | 15 | 64 | 120 | 77 | 78 | | | | |
| B*670102 | 15 | 13 | 128 | 43 | 64 | 120 | 132 | 113 | | |
| B*6702 | 265 | | | | | | | | | |
| B*7301 | 266 | | | | | | | | | |
| B*7801 | 213 | 16 | 71 | 45 | 82 | 104 | 54 | | | |
| B*780201 | 16 | 32 | 71 | 45 | 82 | 104 | 54 | | | |
| B*780202 | 213 | 166 | 16 | 32 | 71 | 61 | 97 | 114 | 45 | 37 | 82 |
| B*7803 | 213 | 19 | 98 | 71 | 61 | 97 | 114 | 45 | 37 | 82 | |
| B*7804 | 97 | 114 | 43 | 64 | 37 | 104 | | | | |
| B*7805 | 167 | 165 | 87 | 68 | 32 | 71 | 61 | 97 | 45 | 37 | 82 |
| B*8101 | 267 | | | | | | | | | |
| B*8201 | 268 | | | | | | | | | |
| B*8202 | 269 | | | | | | | | | |
| B*8301 | 151 | 116 | 21 | 30 | 49 | 44 | 37 | 38 | 83 | |

TABLE 8

Allele-Probe List 2

| | | | | | | | | | |
|---|---|---|---|---|---|---|---|---|---|
| B*070201 | 0 | 1 | 2 | 3 | 4 | 5 | 6 | 7 | 8 |
| B*070202 | 9 | | | | | | | | |
| B*070203 | 10 | | | | | | | | |
| B*0703 | 11 | | | | | | | | |
| B*0704 | 12 | | | | | | | | |
| B*0705 | 13 | 14 | | | | | | | |
| B*0706 | 13 | | | | | | | | |
| B*0707 | 15 | | | | | | | | |
| B*0708 | 16 | 11 | | | | | | | |
| B*0709 | 17 | | | | | | | | |
| B*0710 | 18 | | | | | | | | |
| B*0711 | 19 | 17 | | | | | | | |
| B*0712 | 20 | 21 | 22 | 23 | | | | | |
| B*0713 | 24 | 25 | 26 | | | | | | |
| B*0714 | 27 | 20 | 28 | 29 | | | | | |
| B*0715 | 25 | 26 | | | | | | | |
| B*0716 | 30 | 31 | | | | | | | |
| B*0717 | 29 | 17 | | | | | | | |
| B*0718 | 27 | 21 | | | | | | | |
| B*0719 | 12 | 32 | 33 | 34 | | | | | |
| B*0720 | 35 | 36 | | | | | | | |
| B*0721 | 37 | | | | | | | | |
| B*0722 | 38 | | | | | | | | |
| B*0723 | 39 | | | | | | | | |
| B*0724 | 40 | | | | | | | | |
| B*0725 | 41 | 12 | | | | | | | |
| B*0726 | 42 | | | | | | | | |
| B*0727 | 43 | 44 | 45 | 46 | | | | | |
| B*0728 | 29 | 47 | | | | | | | |
| B*0729 | 48 | 49 | | | | | | | |
| B*0730 | 50 | | | | | | | | |
| B*0731 | 51 | 32 | | | | | | | |
| B*0801 | 48 | 52 | | | | | | | |
| B*0802 | 48 | 53 | 52 | | | | | | |
| B*0803 | 54 | 55 | 56 | 13 | 41 | 12 | 51 | 32 | 57 |
| B*0804 | 48 | 43 | 13 | 12 | 51 | 57 | | | |
| B*0805 | 58 | | | | | | | | |
| B*0806 | 48 | 16 | 19 | 13 | 51 | 57 | | | |
| B*0807 | 48 | 16 | 12 | 51 | 57 | | | | |
| B*0809 | 48 | 59 | 13 | 12 | 51 | 57 | | | |
| B*0810 | 48 | 60 | 16 | 13 | 12 | 51 | 57 | | |
| B*0811 | 48 | 16 | 13 | 12 | 57 | | | | |
| B*0812 | 48 | 15 | 13 | 12 | 51 | 57 | | | |
| B*0813 | 48 | 16 | 42 | 51 | 57 | | | | |
| B*0814 | 48 | 61 | 12 | 51 | 57 | | | | |
| B*0815 | 26 | 12 | 32 | 57 | | | | | |
| B*0816 | 62 | 12 | 57 | | | | | | |
| B*0817 | 48 | 43 | 19 | 63 | | | | | |
| B*1301 | 20 | 64 | 52 | | | | | | |
| B*1302 | 65 | 64 | 52 | | | | | | |
| B*1303 | 53 | 59 | 66 | 41 | 42 | 35 | 52 | | |
| B*1304 | 67 | 17 | 42 | 68 | | | | | |
| B*1306 | 64 | 32 | | | | | | | |
| B*1308 | 69 | | | | | | | | |

TABLE 8-continued

| Allele-Probe List 2 | | | | | | | | | | | | | |
|---|---|---|---|---|---|---|---|---|---|---|---|---|---|
| B*1309 | 65 | 59 | 66 | 64 | | | | | | | | | |
| B*1310 | 17 | 64 | | | | | | | | | | | |
| B*1311 | 64 | 63 | | | | | | | | | | | |
| B*1401 | 70 | 71 | 72 | | | | | | | | | | |
| B*1402 | 73 | 70 | 71 | 72 | | | | | | | | | |
| B*1403 | 73 | 70 | 71 | | | | | | | | | | |
| B*1404 | 74 | | | | | | | | | | | | |
| B*1405 | 73 | 75 | 42 | 76 | 77 | | | | | | | | |
| B*140601 | 73 | 75 | 15 | 42 | 76 | 77 | | | | | | | |
| B*140602 | 73 | 75 | 21 | 42 | 76 | 77 | | | | | | | |
| B*15010101 | 78 | 79 | 80 | 43 | 31 | 81 | 82 | 52 | | | | | |
| B*150102 | 83 | 84 | 81 | 35 | | | | | | | | | |
| B*150103 | 85 | | | | | | | | | | | | |
| B*150104 | 86 | 35 | | | | | | | | | | | |
| B*1502 | 78 | 43 | 21 | 29 | 17 | 42 | 82 | 52 | | | | | |
| B*1503 | 78 | 10 | 80 | 43 | 30 | 15 | 17 | 42 | 82 | 52 | | | |
| B*1504 | 78 | 59 | 81 | 82 | 52 | | | | | | | | |
| B*1505 | 15 | 41 | 42 | 35 | 82 | 87 | | | | | | | |
| B*1506 | 88 | 42 | 87 | 52 | | | | | | | | | |
| B*1507 | 79 | 80 | 43 | 31 | 81 | 52 | | | | | | | |
| B*1508 | 78 | 16 | 31 | 81 | 82 | 52 | | | | | | | |
| B*1509 | 78 | 83 | 42 | 82 | 52 | | | | | | | | |
| B*1510 | 78 | 10 | 89 | 30 | 15 | 42 | 82 | 52 | | | | | |
| B*151101 | 78 | 79 | 31 | 81 | 82 | 52 | | | | | | | |
| B*151102 | 90 | | | | | | | | | | | | |
| B*1512 | 91 | | | | | | | | | | | | |
| B*1513 | 78 | 56 | 21 | 29 | 17 | 42 | 82 | 52 | | | | | |
| B*1514 | 78 | 36 | 82 | 52 | | | | | | | | | |
| B*1515 | 78 | 79 | 43 | 31 | 81 | 82 | 52 | | | | | | |
| B*1516 | 92 | 52 | | | | | | | | | | | |
| B*151701 | 93 | 61 | 82 | 87 | 52 | | | | | | | | |
| B*1518 | 78 | 10 | 89 | 30 | 15 | 17 | 42 | 82 | 52 | | | | |
| B*1519 | 94 | | | | | | | | | | | | |
| B*1520 | 78 | 95 | 52 | | | | | | | | | | |
| B*1521 | 78 | 89 | 21 | 29 | 17 | 42 | 82 | 52 | | | | | |
| B*1523 | 78 | 89 | 30 | 56 | 15 | 17 | 42 | 82 | 52 | | | | |
| B*1524 | 55 | 56 | 15 | 17 | 84 | 81 | 35 | | | | | | |
| B*1525 | 78 | 80 | 43 | 21 | 29 | 17 | 42 | 82 | 52 | | | | |
| B*1527 | 88 | 81 | 35 | | | | | | | | | | |
| B*1528 | 96 | | | | | | | | | | | | |
| B*1529 | 78 | 16 | 30 | 15 | 17 | 42 | 82 | | | | | | |
| B*1530 | 43 | 13 | 84 | 81 | 35 | | | | | | | | |
| B*1531 | 97 | 15 | 29 | 17 | 41 | 42 | 35 | 77 | | | | | |
| B*1532 | 98 | 81 | 35 | | | | | | | | | | |
| B*1533 | 99 | | | | | | | | | | | | |
| B*1534 | 43 | 67 | 17 | 84 | 81 | 35 | | | | | | | |
| B*1535 | 100 | 101 | 17 | 84 | 81 | 35 | | | | | | | |
| B*1536 | 102 | 29 | 17 | 42 | 40 | 35 | 77 | | | | | | |
| B*1537 | 10 | 89 | 31 | 103 | 42 | 35 | 76 | | | | | | |
| B*1538 | 81 | 76 | | | | | | | | | | | |
| B*1539 | 104 | 97 | 80 | 43 | 30 | 15 | 17 | 42 | 35 | 77 | | | |
| B*1540 | 104 | 97 | 80 | 43 | 30 | 15 | 17 | 42 | 77 | | | | |
| B*1542 | 43 | 31 | 65 | 59 | 67 | 66 | 32 | | | | | | |
| B*1543 | 45 | 81 | 35 | 77 | | | | | | | | | |
| B*1544 | 89 | 17 | 84 | 42 | 32 | 77 | | | | | | | |
| B*1545 | 49 | 105 | 79 | 80 | 43 | 31 | 84 | 81 | 35 | | | | |
| B*1546 | 78 | 104 | 106 | 79 | 80 | 43 | 31 | 17 | 81 | 35 | 77 | | |
| B*1547 | 10 | 80 | 43 | 30 | 31 | 15 | 17 | 103 | 84 | 77 | | | |
| B*1548 | 43 | 13 | 107 | 40 | 35 | 77 | | | | | | | |
| B*1549 | 108 | | | | | | | | | | | | |
| B*1550 | 17 | 81 | 32 | | | | | | | | | | |
| B*1551 | 89 | 17 | 41 | 12 | 35 | 109 | 77 | | | | | | |
| B*1552 | 78 | 89 | 15 | 41 | 42 | 77 | | | | | | | |
| B*1553 | 78 | 110 | 106 | 79 | 80 | 43 | 31 | 17 | 81 | 35 | 77 | | |
| B*1554 | 78 | 10 | 80 | 43 | 31 | 81 | 82 | 52 | | | | | |
| B*1555 | 78 | 41 | 42 | 82 | 52 | | | | | | | | |
| B*1556 | 80 | 16 | 31 | 15 | 17 | 84 | 81 | 35 | | | | | |
| B*1557 | 111 | 112 | 35 | 77 | | | | | | | | | |
| B*1558 | 78 | 113 | 81 | 35 | 77 | | | | | | | | |
| B*1560 | 114 | | | | | | | | | | | | |
| B*1561 | 10 | 80 | 43 | 11 | 15 | 17 | 103 | 42 | 35 | 77 | | | |
| B*1562 | 10 | 80 | 43 | 30 | 31 | 20 | 21 | 22 | 23 | 17 | 103 | 84 | 42 | 35 | 77 |
| B*1563 | 49 | 105 | 79 | 80 | 43 | 31 | 15 | 84 | 81 | 35 | | | |
| B*1564 | 10 | 43 | 30 | 31 | 15 | 17 | 103 | 42 | 35 | 77 | | | |
| B*1565 | 49 | 104 | 97 | 80 | 43 | 30 | 31 | 15 | 17 | 84 | 35 | 77 | |
| B*1566 | 78 | 89 | 31 | 81 | 82 | 52 | | | | | | | |
| B*1567 | 115 | | | | | | | | | | | | |

TABLE 8-continued

Allele-Probe List 2

| | | | | | | | | | | | | | | |
|---|---|---|---|---|---|---|---|---|---|---|---|---|---|---|
| B*1568 | 80 | 43 | 31 | 81 | 82 | | | | | | | | | |
| B*1569 | 43 | 17 | 116 | 107 | 32 | 77 | | | | | | | | |
| B*1570 | 49 | 105 | 79 | 80 | 43 | 11 | 15 | 17 | 84 | 81 | 35 | | | |
| B*1571 | 117 | 79 | 80 | 43 | 31 | 15 | 81 | 82 | | | | | | |
| B*1572 | 10 | 89 | 17 | 42 | 35 | 118 | 82 | | | | | | | |
| B*1573 | 66 | 81 | 35 | | | | | | | | | | | |
| B*1574 | 119 | | | | | | | | | | | | | |
| B*1575 | 120 | | | | | | | | | | | | | |
| B*180101 | 121 | 31 | 15 | 52 | | | | | | | | | | |
| B*180102 | 122 | | | | | | | | | | | | | |
| B*1802 | 121 | 123 | 52 | | | | | | | | | | | |
| B*1803 | 121 | 15 | 52 | | | | | | | | | | | |
| B*1804 | 124 | 121 | 43 | 31 | 15 | 41 | 42 | 76 | | | | | | |
| B*1805 | 125 | | | | | | | | | | | | | |
| B*1806 | 126 | 76 | 87 | 52 | | | | | | | | | | |
| B*1807 | 121 | 16 | 31 | 15 | 41 | 42 | 76 | | | | | | | |
| B*1808 | 127 | | | | | | | | | | | | | |
| B*1809 | 121 | 53 | 15 | 41 | 42 | 76 | | | | | | | | |
| B*1810 | 117 | 121 | 43 | 31 | 15 | 41 | 42 | | | | | | | |
| B*1811 | 117 | 121 | 43 | 31 | 15 | 41 | 42 | 32 | | | | | | |
| B*1812 | 121 | 80 | 43 | 31 | 15 | 41 | 42 | 76 | | | | | | |
| B*1813 | 117 | 121 | 43 | 31 | 15 | 41 | 76 | | | | | | | |
| B*1814 | 117 | 121 | 43 | 31 | 41 | 42 | 76 | | | | | | | |
| B*1815 | 117 | 121 | 43 | 31 | 15 | 42 | 76 | | | | | | | |
| B*1818 | 98 | 42 | 76 | | | | | | | | | | | |
| B*2701 | 129 | 130 | 131 | 53 | 132 | 61 | 41 | 42 | 77 | | | | | |
| B*2702 | 55 | 56 | 132 | 61 | 41 | 52 | | | | | | | | |
| B*2703 | 133 | | | | | | | | | | | | | |
| B*2704 | 61 | 134 | | | | | | | | | | | | |
| B*270502 | 129 | 45 | 132 | 61 | 103 | 42 | 52 | | | | | | | |
| B*270503 | 135 | | | | | | | | | | | | | |
| B*270504 | 136 | 129 | 45 | 132 | 123 | 61 | 103 | 41 | 42 | 77 | | | | |
| B*270505 | 137 | | | | | | | | | | | | | |
| B*270506 | 138 | 103 | | | | | | | | | | | | |
| B*2706 | 134 | | | | | | | | | | | | | |
| B*2707 | 45 | 46 | 13 | 42 | 52 | | | | | | | | | |
| B*2708 | 129 | 132 | 61 | 41 | 52 | | | | | | | | | |
| B*2709 | 139 | | | | | | | | | | | | | |
| B*2710 | 129 | 45 | 132 | 123 | 61 | 103 | 42 | 77 | | | | | | |
| B*2711 | 140 | 46 | 13 | 41 | 42 | 52 | | | | | | | | |
| B*2712 | 89 | 11 | 132 | 61 | 41 | 52 | | | | | | | | |
| B*2713 | 141 | | | | | | | | | | | | | |
| B*2714 | 45 | 67 | 61 | 103 | 41 | 42 | 77 | | | | | | | |
| B*2715 | 132 | 61 | 32 | 77 | | | | | | | | | | |
| B*2716 | 89 | 11 | 45 | 132 | 123 | 61 | 103 | 41 | 42 | 77 | | | | |
| B*2717 | 142 | | | | | | | | | | | | | |
| B*2718 | 117 | 110 | 43 | 30 | 31 | 132 | 61 | 103 | 42 | 77 | | | | |
| B*2719 | 45 | 20 | 28 | 61 | 103 | 41 | 42 | 77 | | | | | | |
| B*2720 | 143 | 13 | 42 | 77 | | | | | | | | | | |
| B*2721 | 129 | 46 | 15 | 29 | 103 | 42 | 77 | | | | | | | |
| B*2723 | 16 | 30 | 31 | 144 | 46 | 132 | 61 | 41 | 42 | 77 | | | | |
| B*2724 | 46 | 145 | 77 | | | | | | | | | | | |
| B*2725 | 132 | 35 | 77 | | | | | | | | | | | |
| B*350101 | 16 | 30 | 20 | 21 | 17 | 103 | 41 | 42 | 35 | 95 | 52 | | | |
| B*350102 | 146 | | | | | | | | | | | | | |
| B*3502 | 147 | | | | | | | | | | | | | |
| B*3503 | 148 | 103 | 41 | 42 | 35 | 95 | 52 | | | | | | | |
| B*3504 | 23 | 13 | 103 | 41 | 42 | 35 | 95 | 52 | | | | | | |
| B*3505 | 16 | 30 | 17 | 103 | 41 | 42 | 35 | 95 | 52 | | | | | |
| B*3506 | 149 | 113 | 103 | 41 | 42 | 35 | 95 | 52 | | | | | | |
| B*3507 | 150 | | | | | | | | | | | | | |
| B*3508 | 16 | 30 | 20 | 21 | 17 | 103 | 41 | 35 | 95 | 52 | | | | |
| B*350901 | 23 | 13 | 41 | 42 | 35 | 95 | 52 | | | | | | | |
| B*350902 | 16 | 23 | 13 | 41 | 42 | 35 | 77 | | | | | | | |
| B*3510 | 80 | 16 | 30 | 31 | 20 | 21 | 22 | 23 | 17 | 103 | 151 | 41 | 42 | 35 |
| B*3511 | 16 | 30 | 20 | 21 | 17 | 103 | 42 | 35 | 95 | 52 | | | | |
| B*3512 | 13 | 103 | 41 | 42 | 35 | 95 | 52 | | | | | | | |
| B*3513 | 80 | 16 | 31 | 23 | 148 | 103 | 151 | 41 | 42 | 35 | 77 | | | |
| B*3514 | 151 | 81 | 35 | | | | | | | | | | | |
| B*3515 | 16 | 30 | 20 | 21 | 17 | 103 | 41 | 42 | 95 | 52 | | | | |
| B*3516 | 80 | 16 | 30 | 31 | 152 | 153 | 17 | 103 | 151 | 41 | 42 | 35 | 77 | |
| B*3517 | 154 | 79 | 16 | 30 | 31 | 152 | 153 | 17 | 103 | 151 | 41 | 42 | 35 | 77 |
| B*3518 | 16 | 30 | 20 | 23 | 13 | 41 | 35 | 77 | | | | | | |
| B*3519 | 79 | 16 | 30 | 31 | 20 | 21 | 22 | 23 | 17 | 103 | 151 | 41 | 42 | 35 | 77 |
| B*3520 | 155 | 79 | 43 | 30 | 31 | 20 | 21 | 22 | 23 | 17 | 103 | 151 | 41 | 42 | 35 | 77 |
| B*3521 | 17 | 103 | 151 | 42 | 35 | 76 | | | | | | | | |
| B*3522 | 155 | 16 | 13 | 103 | 151 | 41 | 42 | 35 | 77 | | | | | |
| B*3523 | 88 | 17 | 41 | 42 | 35 | | | | | | | | | |

TABLE 8-continued

Allele-Probe List 2

| | | | | | | | | | | | | | | | | |
|---|---|---|---|---|---|---|---|---|---|---|---|---|---|---|---|---|
| B*3524 | 17 | 41 | 42 | 35 | 76 | | | | | | | | | | | |
| B*3525 | 10 | 16 | 30 | 31 | 20 | 21 | 22 | 23 | 17 | 103 | 151 | 41 | 42 | 35 | 77 | |
| B*3526 | 75 | 40 | 35 | 77 | | | | | | | | | | | | |
| B*3527 | 16 | 30 | 19 | 20 | 21 | 22 | 23 | 17 | 103 | 151 | 41 | 42 | 35 | 77 | | |
| B*3528 | 155 | 79 | 80 | 43 | 30 | 31 | 20 | 21 | 22 | 23 | 17 | 103 | 151 | 41 | 42 | 35 | 77 |
| B*3529 | 154 | 79 | 16 | 11 | 20 | 21 | 22 | 23 | 17 | 103 | 151 | 41 | 42 | 35 | 77 | |
| B*3530 | 154 | 79 | 16 | 30 | 31 | 152 | 22 | 23 | 17 | 103 | 151 | 41 | 42 | 35 | 77 | |
| B*3531 | 136 | 154 | 16 | 30 | 31 | 13 | 41 | 42 | 52 | | | | | | | |
| B*3532 | 154 | 79 | 16 | 30 | 31 | 15 | 153 | 17 | 103 | 151 | 41 | 42 | 35 | 77 | | |
| B*3533 | 16 | 31 | 23 | 148 | 103 | 151 | 41 | 42 | 77 | | | | | | | |
| B*3534 | 154 | 79 | 16 | 30 | 31 | 20 | 21 | 22 | 23 | 103 | 151 | 41 | 42 | 35 | 77 | |
| B*3535 | 17 | 41 | 116 | 107 | 32 | 77 | | | | | | | | | | |
| B*3536 | 156 | | | | | | | | | | | | | | | |
| B*3537 | 65 | 59 | 22 | 23 | 17 | 103 | 151 | 41 | 42 | 35 | 77 | | | | | |
| B*3538 | 20 | 148 | 151 | 41 | 12 | 35 | 109 | 77 | | | | | | | | |
| B*3539 | 154 | 79 | 16 | 30 | 31 | 27 | 28 | 103 | 151 | 41 | 42 | 35 | 77 | | | |
| B*3541 | 157 | | | | | | | | | | | | | | | |
| B*3542 | 140 | 95 | 87 | | | | | | | | | | | | | |
| B*3543 | 155 | 16 | 31 | 15 | 81 | 52 | | | | | | | | | | |
| B*3544 | 16 | 13 | 84 | 81 | 35 | | | | | | | | | | | |
| B*3545 | 20 | 23 | 17 | 151 | 41 | 35 | 36 | 77 | | | | | | | | |
| B*3701 | 98 | 52 | | | | | | | | | | | | | | |
| B*3702 | 44 | 45 | 132 | 61 | 103 | 42 | 52 | | | | | | | | | |
| B*3704 | 98 | 76 | 52 | | | | | | | | | | | | | |
| B*3705 | 98 | 12 | 32 | | | | | | | | | | | | | |
| B*3801 | 54 | 56 | 15 | 116 | 107 | 71 | 72 | | | | | | | | | |
| B*380201 | 130 | 53 | 15 | 116 | 107 | 71 | 72 | | | | | | | | | |
| B*380202 | 158 | | | | | | | | | | | | | | | |
| B*3803 | 75 | 43 | 130 | 53 | 15 | 149 | 113 | 116 | 107 | 32 | 77 | | | | | |
| B*3804 | 80 | 159 | 130 | 53 | 15 | 149 | 113 | 41 | 116 | 107 | 32 | 77 | | | | |
| B*3805 | 73 | 54 | 56 | 15 | 116 | 107 | 71 | | | | | | | | | |
| B*3806 | 16 | 54 | 56 | 15 | 149 | 113 | 41 | 116 | 107 | 32 | 77 | | | | | |
| B*3807 | 160 | | | | | | | | | | | | | | | |
| B*3808 | 75 | 161 | 162 | 77 | | | | | | | | | | | | |
| B*3809 | 163 | | | | | | | | | | | | | | | |
| B*390101 | 89 | 11 | 15 | 116 | 107 | 71 | 72 | | | | | | | | | |
| B*390103 | 89 | 71 | 52 | | | | | | | | | | | | | |
| B*390104 | 164 | | | | | | | | | | | | | | | |
| B*390201 | 43 | 71 | 52 | | | | | | | | | | | | | |
| B*390202 | 43 | 11 | 15 | 116 | 107 | 71 | 72 | | | | | | | | | |
| B*3903 | 89 | 11 | 116 | 107 | 71 | 72 | | | | | | | | | | |
| B*3904 | 49 | 89 | 11 | 15 | 116 | 107 | 71 | 72 | | | | | | | | |
| B*3905 | 31 | 15 | 116 | 107 | 71 | 72 | | | | | | | | | | |
| B*390601 | 165 | 166 | 116 | 107 | 71 | 72 | | | | | | | | | | |
| B*390602 | 65 | 59 | 116 | 107 | 71 | 72 | | | | | | | | | | |
| B*3907 | 75 | 17 | 116 | 107 | 32 | | | | | | | | | | | |
| B*3908 | 43 | 31 | 15 | 167 | 71 | 72 | | | | | | | | | | |
| B*3909 | 98 | 71 | 72 | | | | | | | | | | | | | |
| B*3910 | 11 | 15 | 116 | 107 | 71 | 72 | | | | | | | | | | |
| B*3911 | 75 | 89 | 31 | 15 | 167 | 82 | | | | | | | | | | |
| B*3912 | 168 | 77 | | | | | | | | | | | | | | |
| B*3913 | 43 | 31 | 15 | 149 | 113 | 41 | 116 | 107 | 32 | 77 | | | | | | |
| B*3914 | 75 | 89 | 11 | 13 | 116 | 107 | 32 | 77 | | | | | | | | |
| B*3915 | 75 | 89 | 11 | 15 | 148 | 116 | 107 | 32 | 77 | | | | | | | |
| B*3916 | 169 | | | | | | | | | | | | | | | |
| B*3917 | 66 | 107 | 32 | | | | | | | | | | | | | |
| B*3918 | 75 | 170 | 171 | 32 | 77 | | | | | | | | | | | |
| B*3919 | 79 | 89 | 11 | 15 | 149 | 113 | 41 | 116 | 107 | 32 | 77 | | | | | |
| B*3920 | 19 | 15 | 149 | 113 | 41 | 116 | 107 | 32 | 77 | | | | | | | |
| B*3922 | 75 | 80 | 89 | 11 | 15 | 149 | 113 | 116 | 107 | 32 | 77 | | | | | |
| B*3923 | 172 | | | | | | | | | | | | | | | |
| B*3924 | 173 | | | | | | | | | | | | | | | |
| B*3926 | 174 | | | | | | | | | | | | | | | |
| B*3927 | 11 | 26 | 107 | 32 | 77 | | | | | | | | | | | |
| B*400101 | 175 | | | | | | | | | | | | | | | |
| B*400102 | 176 | 177 | 110 | 106 | 178 | 79 | 80 | 43 | 31 | 15 | 13 | 179 | 41 | | | |
| B*400103 | 177 | 110 | 106 | 178 | 80 | 43 | 31 | 15 | 13 | 179 | 41 | | | | | |
| B*4002 | 140 | 43 | 31 | 13 | 41 | 42 | 52 | | | | | | | | | |
| B*4003 | 140 | 80 | 43 | 31 | 17 | 41 | 42 | 52 | | | | | | | | |
| B*4004 | 140 | 67 | 13 | 41 | 42 | 52 | | | | | | | | | | |
| B*4005 | 140 | 13 | 42 | 35 | 52 | | | | | | | | | | | |
| B*400601 | 140 | 65 | 59 | 13 | 41 | 42 | 52 | | | | | | | | | |
| B*4007 | 16 | 31 | 15 | 13 | 179 | 41 | | | | | | | | | | |
| B*4008 | 140 | 16 | 31 | 13 | 41 | 42 | 52 | | | | | | | | | |
| B*4009 | 117 | 110 | 106 | 29 | 41 | 42 | 109 | 77 | | | | | | | | |
| B*4010 | 104 | 106 | 178 | 79 | 80 | 43 | 31 | 15 | 13 | 179 | 41 | | | | | |
| B*4011 | 117 | 110 | 106 | 15 | 13 | 41 | 42 | 109 | 77 | | | | | | | |
| B*4012 | 78 | 10 | 79 | 80 | 43 | 31 | 15 | 13 | 179 | 41 | | | | | | |

TABLE 8-continued

Allele-Probe List 2

| | | | | | | | | | | | |
|---|---|---|---|---|---|---|---|---|---|---|---|
| B*4013 | 140 | 55 | 56 | 13 | 41 | 42 | | | | | |
| B*401401 | 177 | 110 | 106 | 13 | 151 | 41 | 42 | | | | |
| B*401402 | 177 | 110 | 106 | 13 | 84 | 41 | 42 | | | | |
| B*4015 | 181 | | | | | | | | | | |
| B*4016 | 176 | 43 | 30 | 31 | 13 | | | | | | |
| B*4018 | 117 | 110 | 106 | 43 | 41 | 42 | 109 | 77 | | | |
| B*4019 | 106 | 43 | 30 | 54 | 13 | 41 | 42 | 77 | | | |
| B*4020 | 140 | 80 | 43 | 31 | 15 | 17 | 41 | 42 | | | |
| B*4021 | 105 | 79 | 80 | 43 | 31 | 15 | 13 | 179 | 41 | | |
| B*4023 | 176 | 177 | 110 | 106 | 178 | 79 | 80 | 43 | 31 | 15 | 13 | 145 |
| B*4024 | 117 | 106 | 79 | 80 | 43 | 30 | 31 | 22 | 23 | 41 | 42 | 77 |
| B*4025 | 177 | 110 | 106 | 178 | 79 | 43 | 31 | 15 | 13 | 179 | 41 |
| B*4026 | 106 | 80 | 43 | 31 | 83 | 42 | 35 | | | | |
| B*4027 | 182 | | | | | | | | | | |
| B*4028 | 67 | 83 | 42 | 35 | 76 | | | | | | |
| B*4029 | 183 | 13 | | | | | | | | | |
| B*4030 | 184 | 179 | 42 | | | | | | | | |
| B*4031 | 177 | 110 | 106 | 178 | 79 | 80 | 43 | 31 | 179 | 41 | |
| B*4032 | 177 | 49 | 110 | 106 | 79 | 80 | 43 | 31 | | | |
| B*4033 | 177 | 110 | 106 | 178 | 79 | 80 | 43 | 31 | 15 | 179 | 41 |
| B*4034 | 185 | | | | | | | | | | |
| B*4035 | 117 | 110 | 106 | 13 | 103 | 41 | 42 | 109 | 77 | | |
| B*4036 | 15 | 113 | 179 | 41 | | | | | | | |
| B*4037 | 117 | 110 | 106 | 43 | 19 | 13 | 41 | 42 | 109 | 77 | |
| B*4038 | 186 | 179 | 41 | | | | | | | | |
| B*4039 | 140 | 13 | 42 | 32 | 63 | | | | | | |
| B*4040 | 110 | 106 | 43 | 13 | 41 | 42 | 109 | 77 | | | |
| B*4042 | 29 | 179 | 41 | | | | | | | | |
| B*4043 | 177 | 110 | 106 | 178 | 79 | 80 | 43 | 15 | 13 | 179 | 41 |
| B*4044 | 110 | 106 | 43 | 31 | 65 | 59 | 41 | 42 | 77 | | |
| B*4101 | 176 | 21 | 12 | 32 | 52 | | | | | | |
| B*4102 | 176 | 12 | 32 | 52 | | | | | | | |
| B*4103 | 168 | 12 | | | | | | | | | |
| B*4104 | 23 | 41 | 12 | 51 | 32 | 57 | | | | | |
| B*4105 | 187 | | | | | | | | | | |
| B*4106 | 188 | 12 | 32 | 189 | | | | | | | |
| B*4201 | 12 | 32 | 52 | | | | | | | | |
| B*4202 | 117 | 13 | 41 | 12 | 51 | 32 | 57 | | | | |
| B*4204 | 65 | 59 | 13 | 41 | 12 | 51 | 32 | 57 | | | |
| B*440201 | 106 | 53 | 12 | 35 | 190 | 52 | | | | | |
| B*440202 | 191 | 53 | 12 | 35 | 190 | | | | | | |
| B*440203 | 192 | | | | | | | | | | |
| B*440301 | 106 | 42 | 35 | 190 | 52 | | | | | | |
| B*440302 | 106 | 21 | 42 | 35 | 190 | 52 | | | | | |
| B*4404 | 32 | 190 | 52 | | | | | | | | |
| B*4405 | 80 | 130 | 193 | 53 | 20 | 29 | 12 | 35 | 36 | 77 | |
| B*4406 | 194 | 12 | 36 | | | | | | | | |
| B*4407 | 21 | 42 | 35 | 190 | 52 | | | | | | |
| B*4408 | 105 | 53 | 12 | 35 | 190 | 52 | | | | | |
| B*4409 | 106 | 12 | 35 | 190 | 52 | | | | | | |
| B*4410 | 88 | 42 | 36 | | | | | | | | |
| B*4411 | 49 | 106 | 79 | 80 | 195 | 196 | 20 | 29 | 47 | 12 | 35 | 36 | 77 |
| B*4412 | 49 | 106 | 79 | 130 | 193 | 53 | 20 | 29 | 47 | 12 | 35 | 36 | 77 |
| B*4413 | 197 | | | | | | | | | | |
| B*4414 | 198 | 199 | 12 | 35 | 36 | 77 | | | | | |
| B*4415 | 130 | 53 | 200 | 66 | 12 | 36 | | | | | |
| B*4416 | 49 | 106 | 79 | 80 | 102 | 193 | 20 | 29 | 47 | 12 | 77 | |
| B*4417 | 17 | 12 | 35 | 36 | 77 | | | | | | |
| B*4418 | 176 | 56 | 200 | 12 | 36 | 77 | | | | | |
| B*4420 | 59 | 29 | 47 | 12 | 35 | 36 | 77 | | | | |
| B*4421 | 49 | 106 | 79 | 80 | 130 | 193 | 53 | 20 | 29 | 47 | 12 | 36 | 77 |
| B*4422 | 106 | 79 | 80 | 130 | 193 | 53 | 20 | 29 | 47 | 12 | 35 | 36 | 77 |
| B*4424 | 201 | 36 | 77 | | | | | | | | |
| B*4425 | 43 | 54 | 202 | 56 | 20 | 29 | 12 | 35 | 36 | 77 | |
| B*4426 | 203 | | | | | | | | | | |
| B*4427 | 106 | 53 | 47 | 12 | 35 | 36 | 82 | | | | |
| B*4428 | 106 | 20 | 21 | 29 | 47 | 151 | 41 | 35 | 36 | 77 | |
| B*4429 | 107 | 36 | 77 | | | | | | | | |
| B*4430 | 204 | | | | | | | | | | |
| B*4431 | 179 | 36 | | | | | | | | | |
| B*4432 | 183 | 36 | | | | | | | | | |
| B*4433 | 205 | | | | | | | | | | |
| B*4501 | 176 | 200 | 12 | 36 | 82 | 87 | 52 | | | | |
| B*4502 | 31 | 200 | 113 | 12 | 35 | 36 | 77 | | | | |
| B*4503 | 206 | | | | | | | | | | |
| B*4504 | 176 | 200 | 12 | 82 | 87 | 52 | | | | | |
| B*4505 | 207 | | | | | | | | | | |
| B*4506 | 200 | 66 | 12 | 36 | | | | | | | |

TABLE 8-continued

Allele-Probe List 2

| | | | | | | | | | | | | | |
|---|---|---|---|---|---|---|---|---|---|---|---|---|---|
| B*4601 | 208 | 52 | | | | | | | | | | | |
| B*4602 | 209 | | | | | | | | | | | | |
| B*470101 | 210 | | | | | | | | | | | | |
| B*4702 | 88 | 41 | 42 | 63 | | | | | | | | | |
| B*4703 | 211 | 88 | 61 | 41 | 42 | | | | | | | | |
| B*4704 | 30 | 130 | 131 | 53 | 132 | 61 | 41 | 42 | 77 | | | | |
| B*4801 | 31 | 212 | | | | | | | | | | | |
| B*4802 | 43 | 30 | 20 | 21 | 17 | 103 | 41 | 42 | 35 | 95 | 52 | | |
| B*4803 | 80 | 43 | 31 | 15 | 13 | 179 | 41 | | | | | | |
| B*4804 | 213 | 212 | | | | | | | | | | | |
| B*4805 | 214 | 80 | 43 | 31 | 13 | | | | | | | | |
| B*4806 | 16 | 31 | 13 | 179 | 41 | | | | | | | | |
| B*4807 | 113 | 179 | 41 | | | | | | | | | | |
| B*4901 | 176 | 56 | 42 | 82 | 87 | 52 | | | | | | | |
| B*4902 | 130 | 53 | 66 | 42 | 82 | | | | | | | | |
| B*4903 | 154 | 54 | 56 | 22 | 200 | 66 | 42 | 35 | | | | | |
| B*5001 | 176 | 42 | 82 | 87 | 52 | | | | | | | | |
| B*5002 | 176 | 42 | 36 | 82 | 87 | 52 | | | | | | | |
| B*5004 | 106 | 200 | 66 | 42 | 35 | | | | | | | | |
| B*510101 | 194 | 16 | 56 | 65 | 42 | 76 | 95 | 52 | | | | | |
| B*510102 | 16 | 56 | 65 | 42 | 76 | 95 | 52 | | | | | | |
| B*510103 | 194 | 16 | 56 | 65 | 59 | 83 | 103 | 42 | 35 | 76 | | | |
| B*510104 | 194 | 79 | 16 | 56 | 65 | 59 | 13 | 103 | 42 | 35 | 76 | | |
| B*510105 | 118 | 95 | 87 | | | | | | | | | | |
| B*510201 | 194 | 16 | 56 | 65 | 83 | 103 | 42 | 35 | 95 | 52 | | | |
| B*510202 | 16 | 56 | 65 | 83 | 103 | 42 | 35 | 95 | 52 | | | | |
| B*5103 | 215 | 95 | | | | | | | | | | | |
| B*5104 | 20 | 42 | 76 | 95 | 52 | | | | | | | | |
| B*5105 | 56 | 83 | 103 | 41 | 35 | 95 | | | | | | | |
| B*5106 | 194 | 79 | 16 | 56 | 83 | 103 | 42 | 35 | 76 | | | | |
| B*5107 | 194 | 155 | 43 | 56 | 65 | 59 | 83 | 103 | 42 | 35 | 76 | | |
| B*5108 | 12 | 76 | 95 | 52 | | | | | | | | | |
| B*5109 | 194 | 41 | 42 | 35 | 76 | | | | | | | | |
| B*5110 | 56 | 65 | 59 | 13 | 41 | 42 | 95 | | | | | | |
| B*5112 | 216 | | | | | | | | | | | | |
| B*511301 | 194 | 113 | 103 | 42 | 35 | 76 | | | | | | | |
| B*511302 | 194 | 113 | 83 | 103 | 42 | 35 | 76 | | | | | | |
| B*5114 | 217 | | | | | | | | | | | | |
| B*5115 | 54 | 56 | 65 | 59 | 67 | 66 | 41 | 42 | 35 | | | | |
| B*5116 | 194 | 79 | 16 | 56 | 65 | 59 | 83 | 103 | 42 | 76 | | | |
| B*5117 | 218 | | | | | | | | | | | | |
| B*5118 | 219 | | | | | | | | | | | | |
| B*5119 | 194 | 107 | 35 | 76 | | | | | | | | | |
| B*5120 | 194 | 12 | 35 | 76 | | | | | | | | | |
| B*5121 | 194 | 83 | 32 | 76 | | | | | | | | | |
| B*5122 | 194 | 89 | 56 | 65 | 59 | 83 | 103 | 42 | 35 | 76 | | | |
| B*5123 | 194 | 42 | 36 | | | | | | | | | | |
| B*5124 | 194 | 79 | 16 | 56 | 65 | 59 | 13 | 42 | 35 | 76 | | | |
| B*5126 | 220 | | | | | | | | | | | | |
| B*5128 | 221 | | | | | | | | | | | | |
| B*5129 | 194 | 16 | 56 | 65 | 76 | 95 | | | | | | | |
| B*5130 | 95 | 222 | | | | | | | | | | | |
| B*5131 | 194 | 83 | 41 | 42 | 76 | | | | | | | | |
| B*5132 | 223 | | | | | | | | | | | | |
| B*5133 | 92 | 76 | | | | | | | | | | | |
| B*5134 | 194 | 79 | 16 | 56 | 65 | 59 | 83 | 103 | 151 | 42 | | | |
| B*520101 | 224 | 43 | 56 | 65 | 42 | 76 | 95 | 52 | | | | | |
| B*520102 | 194 | 43 | 56 | 65 | 42 | 76 | 95 | 52 | | | | | |
| B*520103 | 225 | 80 | 43 | 56 | 65 | 59 | 83 | 42 | 35 | 76 | | | |
| B*520104 | 226 | | | | | | | | | | | | |
| B*5202 | 194 | 97 | 80 | 43 | 56 | 65 | 59 | 83 | 103 | 42 | 35 | 76 | |
| B*5203 | 194 | 43 | 41 | 42 | 35 | | | | | | | | |
| B*5204 | 227 | | | | | | | | | | | | |
| B*5205 | 228 | | | | | | | | | | | | |
| B*5301 | 30 | 56 | 20 | 21 | 17 | 103 | 41 | 42 | 35 | 95 | 52 | | |
| B*5302 | 56 | 17 | 41 | 42 | 35 | 76 | | | | | | | |
| B*5303 | 45 | 42 | 35 | 77 | | | | | | | | | |
| B*5304 | 54 | 56 | 23 | 148 | 103 | 151 | 41 | 42 | 35 | 77 | | | |
| B*5305 | 30 | 54 | 55 | 56 | 20 | 21 | 22 | 23 | 17 | 103 | 151 | 41 | 42 | 35 | 77 |
| B*5306 | 194 | 17 | 103 | 42 | 35 | 76 | | | | | | | |
| B*5307 | 98 | 42 | 35 | | | | | | | | | | |
| B*5308 | 30 | 19 | 54 | 55 | 56 | 20 | 21 | 22 | 23 | 17 | 103 | 151 | 42 | 35 | 77 |
| B*5309 | 102 | 17 | 151 | 41 | 42 | 40 | 35 | 77 | | | | | |
| B*5401 | 86 | 52 | | | | | | | | | | | |
| B*5402 | 117 | 86 | 32 | | | | | | | | | | |
| B*5501 | 176 | 32 | 87 | 52 | | | | | | | | | |
| B*5502 | 176 | 41 | 32 | 87 | 52 | | | | | | | | |
| B*5503 | 26 | 66 | 32 | 77 | | | | | | | | | |

TABLE 8-continued

Allele-Probe List 2

| | | | | | | | | | | | | | |
|---|---|---|---|---|---|---|---|---|---|---|---|---|---|
| B*5504 | 49 | 104 | 10 | 13 | 151 | 41 | 42 | 32 | 109 | 77 | | | |
| B*5505 | 229 | | | | | | | | | | | | |
| B*5507 | 49 | 230 | 66 | 77 | | | | | | | | | |
| B*5508 | 104 | 10 | 15 | 13 | 151 | 41 | 42 | 35 | 77 | | | | |
| B*5509 | 49 | 104 | 10 | 65 | 59 | 67 | 66 | 151 | | | | | |
| B*5510 | 65 | 59 | 67 | 66 | 41 | 32 | | | | | | | |
| B*5511 | 231 | 32 | 77 | | | | | | | | | | |
| B*5512 | 176 | 19 | 41 | 32 | 87 | 52 | | | | | | | |
| B*5601 | 176 | 59 | 41 | 42 | 35 | 87 | 52 | | | | | | |
| B*5602 | 176 | 41 | 42 | 35 | 87 | 52 | | | | | | | |
| B*5603 | 176 | 81 | 82 | 87 | 52 | | | | | | | | |
| B*5604 | 104 | 10 | 66 | 41 | 42 | 35 | | | | | | | |
| B*5605 | 194 | 10 | 65 | 59 | 83 | 103 | 42 | 35 | 76 | | | | |
| B*5606 | 194 | 155 | 79 | 65 | 59 | 83 | 103 | 42 | 35 | 76 | | | |
| B*5607 | 10 | 130 | 53 | 65 | 59 | 67 | 66 | 41 | 42 | 35 | | | |
| B*5608 | 232 | 42 | 35 | 77 | | | | | | | | | |
| B*5609 | 104 | 10 | 20 | 21 | 22 | 23 | 17 | 103 | 151 | 41 | 42 | 35 | 77 |
| B*5610 | 49 | 104 | 10 | 67 | 66 | 41 | 32 | | | | | | |
| B*5611 | 176 | 23 | 151 | 41 | 42 | 35 | 77 | 63 | | | | | |
| B*570101 | 233 | 17 | 42 | 68 | | | | | | | | | |
| B*570102 | 234 | | | | | | | | | | | | |
| B*5702 | 13 | 68 | | | | | | | | | | | |
| B*570301 | 13 | 42 | 68 | | | | | | | | | | |
| B*570302 | 235 | | | | | | | | | | | | |
| B*5704 | 184 | 47 | 41 | 77 | | | | | | | | | |
| B*5705 | 236 | 200 | 237 | 41 | 35 | | | | | | | | |
| B*5706 | 238 | | | | | | | | | | | | |
| B*5707 | 184 | 36 | 77 | | | | | | | | | | |
| B*5708 | 239 | | | | | | | | | | | | |
| B*5709 | 184 | 12 | 77 | | | | | | | | | | |
| B*5801 | 236 | 20 | 87 | 52 | | | | | | | | | |
| B*5802 | 70 | 52 | | | | | | | | | | | |
| B*5804 | 240 | | | | | | | | | | | | |
| B*5805 | 241 | | | | | | | | | | | | |
| B*5806 | 70 | 35 | | | | | | | | | | | |
| B*5807 | 70 | 36 | | | | | | | | | | | |
| B*5901 | 176 | 56 | 41 | 32 | 87 | 52 | | | | | | | |
| B*670101 | 75 | 15 | 116 | 107 | 71 | 72 | | | | | | | |
| B*670102 | 15 | 149 | 113 | 41 | 116 | 107 | 32 | 242 | | | | | |
| B*6702 | 243 | | | | | | | | | | | | |
| B*7301 | 244 | | | | | | | | | | | | |
| B*7801 | 194 | 16 | 65 | 42 | 76 | 95 | 52 | | | | | | |
| B*780201 | 16 | 31 | 65 | 42 | 76 | 95 | 52 | | | | | | |
| B*780202 | 194 | 79 | 16 | 31 | 65 | 59 | 83 | 103 | 42 | 35 | 76 | | |
| B*7803 | 194 | 89 | 11 | 65 | 59 | 83 | 103 | 42 | 35 | 76 | | | |
| B*7804 | 83 | 103 | 41 | 42 | 35 | 95 | | | | | | | |
| B*7805 | 155 | 154 | 80 | 43 | 31 | 65 | 59 | 83 | 42 | 35 | 76 | | |
| B*8101 | 136 | 212 | | | | | | | | | | | |
| B*8201 | 245 | | | | | | | | | | | | |
| B*8202 | 246 | | | | | | | | | | | | |
| B*8301 | 136 | 49 | 20 | 29 | 47 | 12 | 35 | 36 | 77 | | | | |

Example 5

Probes for Identification of HLA-C Allele

Extraction of DNA from 1 ml of human blood was performed using GFX Genomic Blood DNA Purification Kit from Amersham Biosciences in the same manner as in Example 1.

Next, quantitative PCR was carried out in the same manner as in Example 1 except that probes in the probe list in Tables 9-1 to 9-4 were used respectively, and 3 µl of the mixed primers consisting of 1 µl each of the respective solutions of the following primers (10 pmol/µl) was used:

```
AAACACGGTCACCTCAGGGGAT    (SEQ ID NO: 1992)

GGCCTGAGTGTGGTTGGAACG     (SEQ ID NO: 1993)

CCAGCTCGTAGTTGTGTCTGCA.   (SEQ ID NO: 1994)
```

After PCR amplification, the sample was identified being Cw*120202, referring to Amp Plot and Dissociation curves on a display of 5700 software and the allele-probe list in Tables 11-1 to 11-4.

Example 6

Extraction of DNA from 1 ml of human blood was performed in the same manner as in Example 1. PCR of human HLA-C was then performed in the same manner as in Example 2 except that 6 µl of the mixed primer consisting of 1 µl each of the solutions containing the following sequences at 10 pmol/µl respectively and 9 µl of ultra pure water was used.

```
AAACACGGTCACCTCAGGGGAT    (SEQ ID NO: 1992)

GGCCTGAGTGTGGTTGGAACG     (SEQ ID NO: 1993)
```

-continued

CCAGCTCGTAGTTGTGTCTGCA  (SEQ ID NO: 1994)

CCATGTGTCAACTTATGCC  (SEQ ID NO: 1995)

AGAATTACCTTTTCCAG  (SEQ ID NO: 1996)

AGAATTACGTTTTCCAG  (SEQ ID NO: 1997)

At the same time, a DNA microarray was prepared to identify the allele in the specimen in the same manner as in Example 2. Probes in Tables 10-1 to 10-4 were used for the probe spots respectively.

Then, hybridization and fluorescence determination was performed using the above-prepared sample and the DNA microarray in the same manner as in Example 2 and the sample was identified as Cw*120202 referring to the probe-allele list in Tables 12-1 to 12-4.

Allele list
Cw*0102:

(SEQ ID NO: 1653)
atgcgggtcatggcgccccgaaccctcatcctgctgctctcgggagccctggccctgaccgagacctgggcctgct cccactccatgaagtatttcttcacatccgtgtcccggcctggccgcggagagccccgcttcatctcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggccgggtctcacaccctccagtggatgtGtggctgcgacct ggggcccgacgggcgcctcctccgcgggtatgaccagtAcgcctacgacggcaaggattacatcgccctgaacgag gacctgcgctcctggaccgccgcggacacCgcggctcagatcacccagcgcaagtgggaggcggcccgtgaggcgg agcagcggagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaactcaggacaccgagc ttgtggagaccaggccagcaggagatggaaccttccagaagtgggcagctgtgAtggtgccttctggagaagagca gagatacacgtgccatgtgcagcacgaggggctgccggagcccctcaccctgagatgggagccgtcttcccagccc accatccccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*0103:

(SEQ ID NO: 1654)
atgcgggtcatggcgccccgaaccctcatcctgctgctctcgggagccctggccctgaccgagacctgggcctgct cccactccatgaagtatttcttcacatccgtgtcccggcctggccgcggagagccccgcttcatctcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggccgggtctcacaccctccagtggatgtgtggctgcgacct ggggcccgacgggcgcctcctccgcgggtatAaccagttcgcctacgacggcaaggattacatcgccctgaacgag gacctgcgctcctggaccgccgcggacaccgcggctcagatcacccagcgcaagtgggaggcggcccgtgaggcgg agcagcggagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaactcaggacaccgagc ttgtggagaccaggccagcaggagatggaaccttccagaagtgggcagctgtgatggtgccttctggagaagagca gagatacacgtgccatgtgcagcacgaggggctgccggagcccctcaccctgagatgggagccgtcttcccagccc accatccccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*0104:

(SEQ ID NO: 1655)

atgcgggtcatggcgcccgaaccctcatcctgctgctctcggggagccctggccctgaccgagacctgggcctgct cccactccatgaagtatttcttcacatccgtgtcccggcctggccgcggagagccccgcttcatctcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggccgggtctcacaccctccagtggatgtgtggctgcgacct ggggcccgacgggcgcctcctccgcgggtatgaccagtccgcctacgacggcaaggattacatcgccctgaacgag gacctgcgctcctggaccgcTgcggacacggcggctcagatcacccagcgcaagtgggaggcggcccgtgaggcgg agcagtggagagcctacctggagggcacgtgcgtggagtggctccgcagatacctggagaacgggaaggagacgct gcagcgcgcggaacacccaaagacacacgtgacccaccatccctgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccAgagcccctcaccctgagatgggagccatcttcccagccc accatcccatcgtgggcatcgttgctggcctggctgtcctggctgtcctagctgtcctaggagctgtgAtggctg ttgtgatgtgtaggaggaagagctcaggtggaaaaggagggagctgctctcaggctgcgtccagcaacagtgccca gggctctgatgagtctctcatcgcttgtaa;

Cw*0105:

(SEQ ID NO: 1656)

gctcccactccatgaagtatttcttcacatccgtgtcccggcctggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccgggtctcacaccctccagaggatgtCtggctgcga cctggggcccgacgggcgcctcctccgcgggtatgaccagtacgcctacgacggcaaggattacatcgccctgaac gaggacctgcgctcctggaccgccgcggacaccgcggctcagatcacccagcgcaagtgggaggcggcccgtgagg cggagcagcggagagcctacctggagggcacgtgcgtggagtggctccgcagatacctggagaacgggaaggagac gctgcagcgcgcgcgg;

Cw*0106:

(SEQ ID NO: 1657)

gctcccactccatgaagtatttcttcacatccgtgtcccggcctggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccgggtctcacaccctccagtggatgtgtggctgcga cctggggcccgacgggcgcctcctccgcgggtatgaccagtacgcctacgacggcaaggattacatcgccctgaac gaggacctgcgctcctggaccgccgcggacaccgcggctcagatcacccagcgcaagtgggaggcggcccgtgTgg cggagcagcggagagcctacctggagggcacgtgcgtggagtggctccgcagatacctggagaacgggaaggagac gctgcagcgcgcgcgg;

Cw*0107:

(SEQ ID NO: 1658)

gctcccactccatgaagtatttcttcacatccgtgtcccggcctggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccgggtctcacaccctccagtggatgtgtggctgcga cctggggcccgacgggcgcctcctccgcAggtatgaccagtacgcctacgacggcaaggattacatcgccctgaac gaggacctgcgctcctggaccgccgcggacaccgcggctcagatcacccagcgcaagtgggaggcggcccgtgagg cggagcagcggagagcctacctggagggcacgtgcgtggagtggctccgcagatacctggagaacgggaaggagac gctgcagcgcgcgg;

Cw*0108:
(SEQ ID NO: 1659)
gctcccactccatgaagtatttcttcacatccgtgtcccggcctggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccgggtctcacaccctccagtggatgtgtggctgcga cctggggcccgacgggcgcctcctccgcgggtatgaccagtacgcctacgacggcaaggattacatcgccctgaac gaggacctgcgctcctggaccgccgcggacaccgcggctcagatcacccagcgcaagtgggaggcggccTgtgagg cggagcagcggagagcctacctggagggcacgtgcgtggagtggctccgcagatacctggagaacgggaaggagac gctgcagcgcgcgg;

Cw*0109:
(SEQ ID NO: 1660)
gctcccactccatgaagtatttcttcacatccgtgtcccggcctggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccgggtctcacaccctccagtggatgtgtggctgcga cctggggcccgacgggcgcctcctccgcgggtatgaccagtacgcctacgacggcaaggattacatcgccctgaac gaggacctgcgctcctggaccgccgcggacaccgcggctcagatcacccagcgcaagtgggaggcggcccgtgagg cggagcagTggagagcctacctggagggcacgtgcgtggagtggctccgcagatacctggagaacgggaaggagac gctgcagcgcgcgg;

Cw*020201:
(SEQ ID NO: 1661)
atgcgggtcatggcgccccgaaccctcctcctgctgctctcgggagccctggccctgaccgagacctgggcctgct cccactccatgaggtatttctacaccgctgtgtcccggcccagccgcggagagccccacttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaagtacaagcgccaggcacagactgaccgagtgaacc tgcggaaactAcgcggctactacaaccagagcgaggccgggtctcacaccctccagaggatgtacggctgcgacct ggggcccgacgggcgcctcctccgcgggtatgaccagtccgcctacgacggcaaggattacatcgccctgaacgag gacctgcgctcctggaccgccgcggacacagcggctcagatcacccagcgcaagtgggaggcggcccgtgaggcgg agcagtggagagcctacctggagggcgagtgcgtggagtggctccgcagatacctggagaacgggaaggagacgct gcagcgcgcggaacaccccaaagacacacgtgacccaccatcccgtctctgaccatgaggccaccctgaggtgctgg gccctgggcttctaccctacggagatcacactgacctggcagcgggatggcgaggaccaaactcaggacaccgagc ttgtggagaccaggccagcaggagatggaaccttccagaagtgggcagctgtggtggtgcccttctggagaagagca gagatacacgtgccatgtgcagcacgaggggctgccggagcccctcaccctgagatgggagccatcttcccagccc accatccccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*020202:
(SEQ ID NO: 1662)
atgcgggtcatggcgccccgaaccctcctcctgctgctctcgggagccctggccctgaccgagacctgggcctgct cccactccatgaggtatttctacaccgctgtgtcccggcccagccgcggagagccccacttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaagtacaagcgccaggcacagactgaccgagtgaacc tgcggaaactgcgcggctactacaaccagagcgaggccgggtctcacaccctccagaggatgtacggctgcgacct ggggcccgacgggcgcctcctccgcgggtatgaccagtccgcctacgacggcaaggattacatcgccctgaacgag gacctgcgctcctggaccgccgcggacacagcggctcagatcacccagcgcaagtgggaggcggcccgtgaggcgg agcagtggagagcctacctggagggcgagtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctAcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccatcttcccagccc accatcccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*020203:

(SEQ ID NO: 1663)
gctcccactccatgaggtatttctacaccgctgtgtcccggcccagccgcggagagccccacttcatcgcagtggg ctacgtggacgacacgcagttcgtgcggttcgacagcgacgccgcgagtccaagaggggagccgcgggcgccgtgg gtggagcaggaggggccggagtattgggaccgggagacacagaagtacaagcgccaggcacagactgaccgagtga acctgcggaaactgcgcggctactacaaccagagcgaggccgggtctcacaccctccagaggatgtatggctgcga cctggggcccgacgggcgcctcctccgcgggtatgaccagtccgcctacgacggcaaggattacatcgccctgaac gaggacctgcgctcctggaccgccgcggacacAgcggctcagatcacccagcgcaagtgggaggcggcccgtgagg cggagcagTggagagcctacctggagggcgagtgcgtggagtggctccgcagatacctggagaacgggaaggagac gctgcagcgcgcgcgg;

Cw*020204:

(SEQ ID NO: 1664)
atgcgggtcatggcgccccgaaccctcctcctgctgctctcgggagccctggccctgaccgagacctgggcctgct cccactccatgaggtatttctacaccgctgtgtcccggcccAgccgcggagagccccacttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaagtacaagcgccaggcacagactgaccgagtgaacc tgcggaaactgcgcggctactacaaccagagcgaggccgggtctcacaccctccagaggatgtacggctgcgacct ggggcccgacgggcgcctcctccgcgggtatgaccagtccgcctacgacggcaaggattacatcgccctgaacgag gacctgcgctcctggaccgccgcggacacGgcggctcagatcacccagcgcaagtgggaggcggcccgtgaggcgg agcagtggagagcctacctggagggcgagtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccAtcttcccagccc accatcccatcgtgggcatcgttgctggcctggctgtcctggctgtcctagctgtcctaggagctgtggtggctg ttgtgatgtgtaggaggaagagctcag;

Cw*020205:

(SEQ ID NO: 1665)
gctcccactccatgaggtatttctacaccgctgtgtcccggcccAgccgcggagagccccacttcatcgcagtggg ctacgtggacgacacgcagttcgtgcggttcgacagcgacgccgcgagtccaagaggggagccgcgggcgccgtgg gtggagcaggaggggccggagtattgggaccgggagacacagaagtacaagcgccaggcacagactgaccgagtga

```
acctgcggaaactgcgcggctactacaaccagagcgaggccgggtctcacaccctccagAggatgtatggctgcga cctggggcccgacgggcgcctcctccgcgggtatgaccagtCcgcctacgacggcaaggattacatcgccctgaac gaggacctgcgctcctggaccgccgcggacacGgcggctcagatcacccagcgcaagtgggaggcggcccgtgagg cggagcagTggagagcctacctggagggcgAgtgcgtggagtggctccgcagatacctggagaacgggaaggagac gctgcagcgcgcgg;
```

Cw*0203:
(SEQ ID NO: 1666)
```
gctcccactccatgaggtatttctacaccgctgtgtcccggcccagccgcggagagccccacttcatcgcagtggg ctacgtggacgacacgcagttcgtgcggttcgacagcgacgccgcgagtccaagaggggagccgcgggcgccgtgg gtggagcaggaggggccggagtatgggaccgggagacacagaagtacaagcgccaggcacagactgaccgagtga acctgcggaaactgcgcggctactacaaccagagcgaggccgggtctcacaccctccagaggatgtacggctgcga cctggggcccgacgggcgcctcctccgcgggtatgaccagtccgcctacgacggcaaggattacatcgccctgaac gaggacctgcgctcctggaccgccgcggacacagcggctcagatcacccagcgcaagtgggaggcggcccgtgTgg cggagcagctgagagcctacctggagggcgAgtgcgtggagtggctccgcagatacctggagaacgggaaggagac gctgcagcgcgcgg;
```

Cw*0204:
(SEQ ID NO: 1667)
```
gctcccactccatgaggtGtttctacaccgctgtgtcccggcccagccgcggagagccccacttcatcgcagtggg ctacgtggacgacacgcagttcgtgcggttcgacagcgacgccgcgagtccaagaggggagccgcgggcgccgtgg gtggagcaggaggggccggagtatgggaccgggagacacagaagtacaagcgccaggcacagactgaccgagtga acctgcggaaactgcgcggctactacaaccagagcgaggccgggtctcacaccctccagaggatgtacggctgcga cctggggcccgacgggcgcctcctccgcgggtatgaccagtccgcctacgacggcaaggattacatcgccctgaac gaggacctgcgctcctggaccgccgcggacacagcggctcagatcacccagcgcaagtgggaggcggcccgtgagg cggagcagtggagagcctacctggagggcgagtgcgtggagtggctccgcagatacctggagaacgggaaggagac gctgcagcgcgcgg;
```

Cw*0205:
(SEQ ID NO: 1668)
```
gctcccactccatgaggtatttctacaccgctgtgtcccggcccAgccgcggagagccccacttcatcgcagtggg ctacgtggacgacacgcagttcgtgcggttcgacagcgacgccgcgagtccaagaggggagccgcgggcgccgtgg gtggagcaggaggggccggagtatgggaccgggagacacagaagtacaagcgccaggcacagactgaccgagtga acctgcggaaactgcgcggctactacaaccagagcgaggccgggtctcacaccctccagtggatgtatggctgcga cctggggcccgacgggcgcctcctccgcgggtatgaccagtCcgcctacgacggcaaggattacatcgccctgaac gaggacctgcgctcctggaccgccgcggacacGgcggctcagatcacccagcgcaagtgggaggcggcccgtgagg cggagcagTggagagcctacctggagggcgAgtgcgtggagtggctccgcagatacctggagaacgggaaggagac gctgcagcgcgcgg;
```

Cw*0206:
(SEQ ID NO: 1669)
```
gctcccactccatgaggtatttctacaccgctgtgtcccggcccagccgcggagagccccacttcatcgcagtggg ctacgtggacgacacgcagttcgtgcggttcgacagcgacgccgcgagtccaagaggggagccgcgggcgccgtgg gtggagcaggaggggccggagtatgggaccgggagacacagaagtacaagcgccaggcacagactgaccgagtga acctgcggaaactgcgcggctactacaaccagagcgaggccgggtctcacaccctccagaggatgtacggctgcga cctggggcccgacgggcgcctcctccgcgggcatgaccagttAgcctacgacggcaaggattacatcgccctgaac gaggacctgcgctcctggaccgccgcggacacgcggctcagatcacccagcgcaagtgggaggcggcccgtgagg cggagcagtggagagcctacctggagggcgAgtgcgtggagtggctccgcagatacctggagaacgggaaggagac gctgcagcgcgcgg;
```

Cw*030201:

(SEQ ID NO: 1670)
atgcgggtcatggcgccccgaaccctcatcctgctgctctcgggagccctggccctgaccgagacctgggccggct cccactccatgaggtatttctacaccgctgtgtcccggcccggccgcggggagccccacttcatcgcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggccgggtctcacatcctccagaggatgtatggctgcgacgt ggggcccgacgggcgcctcctccgcgggtatgaccagtccgcctacgacggcaaggattacatcgccctgaacgag gatctgcgctcctggaccgccgcggacacggcggctcagatcacccagcgcaagtgggaggcggcccgtgaggcgg agcagctgagagcctacctggagggcctgtgcgtggagtggctccgcagatacctgaagaatgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaactcaggacacTgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccAtcttcccagccc accatccccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*030202:

(SEQ ID NO: 1671)
atgcgggtcatggcgccccgaaccctcatcctgctgctctcgggagccctggccctgaccgagacctgggccggct cccactccatgaggtatttctacaccgctgtgtcccggcccggccgcggggagccccacttcatcgcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggccgggtctcacatcctccagaggatgtatggctgcgacgt ggggcccgacgggcgcctcctccgcgggtatgaccagtCcgcctacgacggcaaggattacatcgccctgaacgag gatctgcgctcctggaccgccgcggacacggcggctcagatcacccagcgcaagtgggaggcggcccgtgaggcgg agcagctgagagcctacctggagggcctgtgcgtggagtggctccgcagatacctgaagaatgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaactcaggacacTgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccgtcttcccagccc accatccccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*030301:

(SEQ ID NO: 1672)
atgcgggtcatggcgccccgaaccctcatcctgctgctctcgggagccctggccctgaccgagacctgggccggct cccactccatgaggtatttctacaccgctgtgtcccggcccggccgcggggagccccacttcatcgcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggccAggtctcacatcAtccagaggatgtatggctgcgacgt ggggcccgacgggcgcctcctccgcgggtatgaccagtacgcctacgacggcaaggattacatcgccctgaacgag gatctgcgctcctggaccgccgcggacacggcggctcagatcacccagcgcaagtgggaggcggcccgtgaggcgg

```
agcagctgagagcctacctggagggcctgtgcgtggagtggctccgcagatacctgaagaatgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaactcaggacactgagc ttgtggagaccaggccagcaggagatggaaccttccagaagtgggcagctgtgGtggtgccttctggagaagagca gagatacacgtgccatgtgcagcacgaggggctgccggagcccctcaccctgagatgggagccgtcttcccagccc accatccccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*030302:
(SEQ ID NO: 1673)
atgcgggtcatggcgccccgaaccctcatcctgctgctctcgggagccctggccctgaccgagacctgggccggct cccactccatgaggtatttctacaccgctgtgtcccggcccggccgcggggagccccacttcatcgcagtgggcta cgtggacgacacgcagttcgtgcggttcgacagcgacgccgcgagtccgagaggggagccgcgggcgccgtgggtg gagcaggaggggccggagtatttgggaccgggagacacagaagtacaagcgccaggcacagactgaccgagtgagcc tgcggaacctgcgcggctactacaaccagagcgaggccaggtctcacatcatccagaggatgtatggctgcgacgt ggggcccgacgggcgcctcctccgcgggtatgaccagtacgcctacgacggcaaggattacatcgccctgaacgag gatctgcgctcctggaccgccgcggacacggcggCcagatcacccagcgcaagtgggaggcggcccgtgaggcgg agcagctgagagcctacctggagggcctgtgcgtggagtggctccgcagatacctgaagaatgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaactcaggacactgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccgtcttcccagccc accatccccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*030303:
(SEQ ID NO: 1674)
gctcccactccatgaggtatttctacaccgctgtgtcccggcccggccgcggggagccccacttcatcgcagtggg ctacgtggacgacacgcagttcgtgcggttcgacagcgacgccgcgagtccgagaggggagccgcgggcgccgtgg gtggagcaggaggggccggagtatttgggaccgggagacacagaagtacaagcgccaggcacagactgaccgagtga gcctgcggaacctgcgcggctactacaaccagagcgaggccaggtctcacatcatccagaggatgtatggctgcga cgtgggAcccgacgggcgcctcctccgcgggtatgaccagtacgcctacgacggcaaggattacatcgccctgaac gaggatctgcgctcctggaccgccgcggacacggcggctcagatcacccagcgcaagtgggaggcggcccgtgagg cggagcagctgagagcctacctggagggcctgtgcgtggagtggctccgcagatacctgaagaatgggaaggagac gctgcagcgcgcgg;

Cw*030401:
(SEQ ID NO: 1675)
atgcgggtcatggcgccccgaaccctcatcctgctgctctcgggagccctggccctgaccgagacctgggccggct cccactccatgaggtatttctacaccgctgtgtcccggcccggccgcggggagccccacttcatcgcagtgggcta cgtggacgacacgcagttcgtgcggttcgacagcgacgccgcgagtccgagaggggagccgcgggcgccgtgggtg gagcaggaggggccggagtatttgggaccgggagacacagaagtacaagcgccaggcacagactgaccgagtgagcc tgcggaacctgcgcggctactacaaccagagcgaggccgggtctcacatcAtccagaggatgtatggctgcgacgt ggggcccgacgggcgcctcctccgcgggtatgaccagtacgcctacgacggcaaggattacatcgccctgaacgag gatctgcgctcctggaccgccgcggacacggcggctcagatcacccagcgcaagtgggaggcggcccgtgaggcgg
``` agcagctgagagcctacctggagggcctgtgcgtggagtggctccgcagatacctgaagaatgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaactcaggacacTgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccgtcttcccagccc accatccccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*030402:

(SEQ ID NO: 1676)
gctcccactccatgaggtatttctacaccgctgtgtcccggcccggccgcggggagccccacttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggcccgggtctcacatcAtccagaggatgtaCggctgcga cgtggggcccgacgggcgcctcctccgcgggtatgaccagtacgcctacgacggcaaggattacatcgccctgaac gaggatctgcgctcctggaccgccgcggacacggcggctcagatcacccagcgcaagtgggaggcggcccgtgagg cggagcagctgagagcctacctggagggcctgtgcgtggagtggctccgcagatacctgaagaaTgggaaggagac gctgcagcgcgcgg;

Cw*0305:

(SEQ ID NO: 1677)
gctcccactccatgaggtatttctacaccgctgtgtcccggcccggccgcggggagccccacttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggcccgggtctcacaccctccagagCatgtacggctgcga cgtggggcccgacgggcgcctcctccgcgggtatgaccagtacgcctacgacggcaaggattacatcgccctgaac gaggatctgcgctcctggaccgccgcggacacggcggctcagatcacccagcgcaagtgggaggcggcccgtgagg cggagcagctgagagcctacctggagggcctgtgcgtggagtggctccgcagatacctgaagaaTgggaaggagac gctgcagcgcgcgg;

Cw*0306:

(SEQ ID NO: 1678
gctcccactccatgaggtatttctacaccgctgtgtcccggcccggccgcggggagccccacttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggcccgggtctcacatcatccagaggatgtatggctgcga cgtggggcccgacgggcgcctcctccgcgggtatgTccagtacgcctacgacggcaaggattacatcgccctgaac gaggatctgcgctcctggaccgccgcggacacggcggctcagatcacccagcgcaagtgggaggcggcccgtgagg cggagcagctgagagcctacctggagggcctgtgcgtggagtggctccgcagatacctgaagaatgggaaggagac gctgcagcgcgcgg;

Cw*0307:

(SEQ ID NO: 1679
gctcccactccatgaggtatttctacaccgctgtgtcccggcccggccgcggggagccccacttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga AcctgcggaaActgcgcggctactacaaccagagcgaggcccgggtctcacatcAtccagaggatgtatggctgcga -continued cGtggggcccgacgggcgcctcctccgcgggtatgaccagtacgcctacgacggcaaggattacatcgccctgaac gaggatctgcgctcctggaccgccgcggacacggcggctcagatcacccagcgcaagtgggaggcggcccgtgagg cggagcagctgagagcctacctggagggccTgtgcgtggagtggctccgcagatacctgaagaaTgggaaggagac gctgcagcgcgcgg;

Cw*0308:

(SEQ ID NO: 1680)
atgcgggtcatggcgccccgaaccctcatcctgctgctctcggggagccctggccctgaccgagacctgggccggct cccactccatgaggtatttctacaccgctgtgtcccggcccggccgcggggagccccacttcatcgcagtgggcta cgtggacgacacgcagttcgtgcggttcgacagcgacgccgcgagtccgagaggggagccgcgggcgccgtgggtg gagcaggaggggccggagtattgggaccgggagacacagaaCtacaagcgccaggcacagactgaccgagtgagcc tgcggaacctgcgcggctactacaaccagagcgaggccgggtctcacatcAtcagaggatgtatggctgcgacgt ggggcccgacgggcgcctcctccgcgggtatgaccagtacgcctacgacggcaaggattacatcgccctgaacgag gatctgcgctcctggaccgccgcggacacggcggctcagatcacccagcgcaagtgggaggcggcccgtgaggcgg agcagctgagagcctacctggagggcctgtgcgtggagtggctccgcagatacctgaagaatgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaactcaggacacTgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccgtcttcccagccc accatcccatcgtgggcatcgttgctggcctggctgtcctggctgtcctagctgtcctaggagctgtggtggctg ttgtgatgtgtaggaggaagagctcag;

Cw*0309:

(SEQ ID NO: 1681)
gctcccactccatgaggtatttctacaccgctgtgtcccggcccggccgcggggagccccacttcatcGcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccgggtctcacatcAtcagaggatgtatggctgcga cctggggcccgacgggcgcctcctccgcgggtatgaccagtacgcctacgacggcaaggattacatcgccctgaac gaggatctgcgctcctggaccgccgcggacacggcggctcagatcacccagcgcaagtgggaggcggcccgtgagg cggagcagctgagagcctacctggagggccTgtgcgtggagtggctccgcagatacctgaagaaTgggaaggagac gctgcagcgcgcgg;

Cw*0310:

(SEQ ID NO: 1682)
gctcccactccatgaggtatttctacaccgctgtgtcccggcccggccgcggggagccccacttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaaActgcgcggctactacaaccagagcgaggccgggtctcacatcAtcagaggatgtatggctgcga cGtggggcccgacgggcgcctcctccgcgggtatgaccagtacgcctacgacggcaaggattacatcgccctgaac gaggatctgcgctcctggaccgccgcggacacggcggctcagatcacccagcgcaagtgggaggcggcccgtgagg cggagcagctgagagcctacctggagggccTgtgcgtggagtggctccgcagatacctgaagaaTgggaaggagac gctgcagcgcgcgg;

Cw*0311:

(SEQ ID NO: 1683)
gctcccactccatgaggtatttctacaccgctgtgtcccggcccggccgcgggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccAggtctcacatcAtccagaggatgtatggctgcga cgtggggcccgacgggcgcctcctccgcgggtatgaccagtacgcctacgacggcaaggattacatcgccctgaac gaggatctgcgctcctggaccgccgcggacacggcggctcagatcacccagcgcaagtgggaggcggcccgtgagg cggagcagctgagagcctacctggagggcctgtgcgtggagtggctccgcagatacctgaagaatgggaaggagac gctgcagcgcgcgg;

Cw*0312:

(SEQ ID NO: 1684)
gctcccactccatgaggtatttctacaccgctgtgtcccggcccggccgcggggagccccacttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccAggtctcacatcatccagaggatgtatggctgcga cgtggggcccgacgggcgcctcctccgcgggtatgaccagttAgcctacgacggcaaggattacatcgccctgaac gaggatctgcgctcctggaccgccgcggacacggcggctcagatcacccagcgcaagtgggaggcggcccgtgagg cggagcagctgagagcctacctggagggcctgtgcgtggagtggctccgcagatacctgaagaatgggaaggagac gctgcagcgcgcgg;

Cw*0313:

(SEQ ID NO: 1685)
atgcgggtcatggcgccccgaaccctcatcctgctgctctcgggagccctggccctgaccgagacctgggccggct cccactccatgaggtatttctacaccgctgtgtcccggcccggccgcggggagccccacttcatcgcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggccAggtctcacaccctccagaggatgtatggctgcgacgt ggggcccgacgggcgcctcctccgcgggtatgaccagtacgcctacgacggcaaggattacatcgccctgaacgag gatctgcgctcctggaccgccgcggacacggcggctcagatcacccagcgcaagtgggaggcggcccgtgaggcgg agcagctgagagcctacctggagggcctgtgcgtggagtggctccgcagatacctgaagaatgggaaggagacgct gcagcgcgcggaacacccaaagacacacgtgacccaccatcccgtctctgaccatgaggccacccttgaggtgctgg gccctgggcttctaccctgcggagatcacactgacctggcagtgggatggggaggaccaaaactcaggacactgagc ttgtggagaccaggccagcaggagatggaaccttccagaagtgggcagctgtgGtggtgccttctggagaagagca gagatacacgtgccatgtgcagcacgaggggctgccggagccccctcaccctgagatgggagccgtcttcccagccc accatccccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*0314:

(SEQ ID NO: 1686)
gctcccactccatgaggtatttctacaccgctgtgtcccggcccggccgcggggagccccacttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccgggtctcacatcatccagaggatgtatggctgcga cgtggggcccgacgggcgcctcctccgcgggtatgaccagtccgcctacgacggcaaggattacatcgccctgaac gaggacctgcgctcctggaccgccgcggacaccgcggctcagatcacccagcgcaagttggaggcggcccgtgCgg cggagcagctgagagcctacctggagggcacgtgcgtggagtggctccgcagatacctgaagaaTgggaaggagac gctgcagcgcgcgg;

-continued

Cw*0315:
(SEQ ID NO: 1687)
gctcccactccatgaggtatttctacaccgctgtgtcccggcccggccgcggggagccccacttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacaggctgaccgagtga acctgcggaaactgcgcggctactacaaccagagcgaggAcgggtctcacatcctccagaggatgtatggctgcga cgtggggcccgacgggcgcctcctccgcgggtatgaccagtCcgcctacgacggcaaggattacatcgccctgaac gaggatctgcgctcctggaccgccgcggacacggcggctcagatcacccagcgcaagtgggaggcggcccgtgagg cggagcagctgagagcctacctggagggccTgtgcgtggagtggctccgcagatacctgaagaaTgggaaggagac gctgcagcgcgcgcgg;

Cw*0316:
(SEQ ID NO: 1688)
gctcccactccatgaggtatttctacaccgctgtgtcccggcccggccgcggggagccccacttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccgggtctcacatcctccagaggatgtatggctgcga cGtggggcccgacgggcgcctcctccgcgggtatgaccagtCcgcctacgacggcaaggattacatcgccctgaac gaggatctgcgctcctggaccgccgcggacacGgcggctcagatcacccagcgcaagtgggaggcggcccgtgagg cggagcagcTgagagcctacctggagggcacgtgcgtggagtggctccgcagatacctggagaacgggaaggagac gctgcagcgcgcgcgg;

Cw*040101:
(SEQ ID NO: 1689)
atgcgggtcatggcgccccgaaccctcatcctgctgctctcgggagccctggccctgaccgagacctgggccggct cccactccatgaggtatttctccacatccgtgtcctggcccggccgcggggagccccgcttcatcgcagtgggcta cgtggacgacacgcagttcgtgcggttcgacagcgacgccgcgagtccaagaggggagccgcgggagccgtgggtg gagcaggaggggccggagtattgggaccgggagacacagaagtacaagcgccaggcacaggctgaccgagtgaacc tgcggaaactgcgcggctactacaaccagagcgaggacgggtctcacaccctccagaggatgtttggctgcgacct ggggccggacgggcgcctcctccgcgggtataaccagttcgcctacgacggcaaggattacatcgccctgaacgag gatctgcgctcctggaccgccgcggacacggcggctcagatcacccagcgcaagtgggaggcggcccgtgaggcgg agcagcggagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaactcaggacaccgagc ttgtggagaccaggccagcaggagatggaaccttccagaagtgggcagctgtggtggtgccttctggagaagagca gagatacacgtgccatgttcagcacgaggggctgccggagcccctcacccctgagatggaagccgtcttcccagcc accatccccatcgtgggcatcgttgctggcctggctgtcctggctgtcctagctgtcctaggagctAtggtggctg ttgtgatgtgtaggaggaagagctcaggtggaaaaggagggagctgctctcaggctgcgtccagcaacagtgccca gggctctgatgagtctctcatcgcttgtaa;

Cw*040102:
(SEQ ID NO: 1690)
gctcccactccatgaggtatttctccacatccgtgtcctggcccggccgcggggagccccgcttcatcgcagtggg ctacgtggacgacacAcagttcgtgcggttcgacagcgacgccgcgagtccaagaggggagccgcgggagccgtgg gtggagcaggaggggccggagtattgggaccgggagacacagaagtacaagcgccaggcacaggctgaccgagtga acctgcggaaactgcgcggctactacaaccagagcgaggacgggtctcacaccctccagaggatgtttggctgcga cctggggccggacgggcgcctcctccgcgggtataaccagttcgcctacgacggcaaggattacatcgccctgaac -continued gaggatctgcgctcctggaccgccgcggacacggcggctcagatcacccagcgcaagtgggaggcggcccgtgagg
cggagcagcggagagcctacctggagggcacgtgcgtggagtggctccgcagatacctggagaacgggaaggagac
gctgcagcgcgcgg;

Cw*0403:

(SEQ ID NO: 1691)
atgcgggtcatggcgccccgaaccctcatcctgctgctctcggggagccctggccctgaccgagacctgggccggct
cccactccatgaggtatttctacaccgctgtgtcccggcccagccgcggagagccccActtcatcgcagtgggcta
cgtggacgacacgcagttcgtgcggttcgacagcgacgccgcgagtccaagaggggagccgcgggcgccgtgggtg
gagcaggaggggccggagtattgggaccgggagacacagaagtacaagcgccaggcacaggctgaccgagtgaacc
tgcggaaactgcgcggctactacaaccagagcgaggacgggtctcacaccctccagaggatgtttggctgcgacct
ggggccggacgggcgcctcctccgcgggtataaccagttcgcctacgacggcaaggattacatcgccctgaacgag
gatctgcgctcctggaccgccgcggacacggcggctcagatcacccagcgcaagtgggaggcggcccgtgaggcgg
agcagcggagagcctacctggagggcacgtgcgtggagtggctccgcagatacctggagaacgggaaggagacgct
gcagcgcgcggaacacccaaagacacacgtgacccaccatcccgtctctgaccatgaggccaccctgaggtgctgg
gccctgggcttctaccctgcggagatcacactgacctggcagtgggatgggggaggaccaaactcaggacaccgagc
ttgtggagaccaggccagcaggagatggaaccttccagaagtgggcagctgtggtggtgccttctggagaagagca
gagatacacgtgccatgtTcagcacgagggggctgccggagcccctcaccctgagatggaagccgtcttcccagccc
accatcccatcgtgggcatcgttgctggcctggctgtcctggctgtcctagctgtcctaggagctgtggtggctg
ttgtgatgtgtaggaggaagagctcaggtggaaaaggagggagctgctctcaggctgcgtccagcaacagtgccca
gggctctgatgagtctctcatcgcttgtaa;

Cw*0404:

(SEQ ID NO: 1692)
gctcccactccatgaggtatttctccacatccgtgtcctggcccggccgcggggagccccgcttcatcgcagtggg
ctacgtggacgacacgcagttcgtgcggttcgacagcgacgccgcgagtccaagaggggagccgcgggAgccgtgg
gtggagcaggaggggccggagtattgggaccgggagacacagaagtacaagcgccaggcacaggctgaccgagtga
acctgcggaaactgcgcggctactacaaccagagcgaggacgggtctcacaccctccagaggatgtttggctgcga
cctggggccggacgggcgcctcctccgcgggtataaccagttcgcctacgacggcaaggattacatcgccctgaac
gaggatctgcgctcctggaccgccgcggacacggcggctcagatcacccagcgcaagtgggaggcggcccgtgagg
cggagcagcTgagagcctacctggagggcacgtgcgtggagtggctccgcagatacctggagaacgggaaggagac
gctgcagcgcgcgg;

Cw*0405:

(SEQ ID NO: 1693)
gctcccactccatgaggtatttctccacatccgtgtcctggcccggccgcggggagccccgcttcatcgcagtggg
ctacCtggacgacacgcagttcgtgcggttcgacagcgacgccgcgagtccaagaggggagccgcgggagccgtgg
gtggagcaggaggggccggagtattgggaccgggagacacagaagtacaagcgccaggcacaggctgaccgagtga
acctgcggaaactgcgcggctactacaaccagagcgaggacgggtctcacaccctccagaggatgtttggctgcga
cctggggccggacgggcgcctcctccgcgggtataaccagttcgcctacgacggcaaggattacatcgccctgaac
gaggatctgcgctcctggaccgccgcggacacggcggctcagatcacccagcgcaagtgggaggcggcccgtgagg
cggagcagcggagagcctacctggagggcacgtgcgtggagtggctccgcagatacctggagaacgggaaggagac
gctgcagcgcgcgg;

Cw*0406:

(SEQ ID NO: 1694)
gctcccactccatgaggtatttctacaccgctgtgtcccggcccagccgcggagagccccActtcatcgcagtggg
ctacgtggacgacacgcagttcgtgcggttcgacagcgacgccgcgagtccaagaggggagccgcgggcgccgtgg
gtggagcaggaggggccggagtattgggaccgggagacacagaagtacaagcgccaggcacaggctgaccgagtga -continued

```
acctgcggaaactgcgcggctactacaaccagagcgaggacgggtctcacaccctccagaggatgtttggctgcga
cctggggccGgacgggcgcctcctccgcgggtataaccagttcgcctacgacggcaaggattacatcgccctgaac
gaggatctgcgctcctggaccgccgcggacacggcggctcagatcacccagcgcaagtgggaggcggcccgtgagg
cggagcagcTgagagcctacctggagggcacgtgcgtggagtggctccgcagatacctggagaacgggaaggagac
gctgcagcgcgcgg;
```

Cw*0407:

(SEQ ID NO: 1695)
```
gctcccactccatgaggtatttctccacatccgtgtccTggcccggccgcggggagccccgcttcatcgcagtggg
ctacgtggacgacacgcagttcgtgcggttcgacagcgacgccgcgagtccaagaggggagccgcgggcgccgtgg
gtggagcaggaggggccggagtattgggaccgggagacacagaagtacaagcgccaggcacagGctgaccgagtga
acctgcggaaactgcgcggctactacaaccagagcgaggacgggtctcacaccctccagaggatgtttggctgcga
cctggggccggacgggcgcctcctccgcgggtataaccagttcgcctacgacggcaaggattacatcgccctgaac
gaggatctgcgctcctggaccgccgcggacacggcggctcagatcacccagcgcaagtgggaggcggcccgtgagg
cggagcagcggagagcctacctggagggcacgtgcgtggagtggctccgcagatacctggagaacgggaaggagac
gctgcagcgcgcgg;
```

Cw*0408:

(SEQ ID NO: 1696)
```
gctcccactccatgaggtatttctccacatccgtgtcctggcccggccgcggggagccccgcttcatcgcagtggg
ctacgtggacgacacgcagttcgtgcggttcgacagcgacgccgcgagtccaagaggggagccgcgggAgccgtgg
gtggagcaggaggggccggagtattgggaccgggagacacagaagtacaagcgccaggcacaggctgaccgagtga
acctgcggaaactgcgcggctactacaaccagagcgaggacgggtctcacaccctccagaggatgtttggctgcga
cctggggccggacgggcgcctcctccgcgggtataaccagttcgcctacgacggcaaggattacatcgccctgaac
gaggatctgcgctcctggaccgccgcggacacggcggctcagatcacccagcgcaagtgggaggcggcccgtgagg
cggagcagcggagagcctacctggagggccTgtgcgtggagtggctccgcagatacctggagaacgggaaggagac
gctgcagcgcgcgg;
```

Cw*0410:

(SEQ ID NO: 1697)
```
gctcccactccatgaggtatttctccacatccgtgtcctggcccggccgcggggagccccgcttcatcgcagtggg
ctacgtggacgacacgcagttcgtgcggttcgacagcgacgccgcgagtccaagaggggagccgcgggAgccgtgg
gtggagcaggaggggccggagtattgggaccgggagacacagaagtacaagcgccaggcacagactgaccgagtga
acctgcggaaactgcgcggctactacaaccagagcgaggacgggtctcacaccctccagaggatgtttggctgcga
cctggggccggacgggcgcctcctccgcgggtataaccagttcgcctacgacggcaaggattacatcgccctgaac
gaggatctgcgctcctggaccgccgcggacacggcggctcagatcacccagcgcaagtgggaggcggcccgtgagg
cggagcagcggagagcctacctggagggcacgtgcgtggagtggctccgcagatacctggagaacgggaaggagac
gctgcagcgcgcgg;
```

Cw*0501:

(SEQ ID NO: 1698)
```
atgcgggtcatggcgccccgaaccctcatcctgctgctctcgggagccctggccctgaccgagacctgggcctgct
cccactccatgaggtatttctacaccgccgtgtcccggcccggccgcgggagagccccgcttcatcgcagtgggcta
cgtggacgacacgcagttcgtgcagttcgacagcgacgccgcgagtccaagaggggagccgcgggcgccgtgggtg
gagcaggaggggccggagtattgggaccgggagacacagaagtacaagcgccaggcacagactgaccgagtgaacc
tgcggaaActgcgcggctactacaaccagagcgaggccgggtctcacaccctccagaggatgtatggctgcgacct
ggggcccgacgggcgcctcctccgcgggtataaccagttcgcctacgacggcaaggattacatcgccctgaatgag
gacctgcgctcctggaccgccgcgggacaAggcggctcagatcacccagcgcaagtgggaggcggcccgtgaggcgg
``` agcagcggagagcctacctggagggcacgtgcgtggagtggctccgcagatacctggagaacgggaagaagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccagagcccctcaccctgagatgggGgccatcttcccagccc accatccccatcgtgggcatcgttgctggcctggctgtcctggctgtcctagctgtcctaggagctgtgatggctg ttgtgatgtgtaggaggaagagctcaggtggaaaaggagggagctgctctcaggctgcgtccagcaacagtgccca gggctctgatgagtctctcatcgcttgtaa;

Cw*0502:

(SEQ ID NO: 1699)

gctcccactccatgaggtatttctacaccgccgtgtcccggcccggccgcggagagccccgcttcatcgcagtggg ctacgtggacgacacgcagttcgtgcagttcgacagcgacgccgcgagtccaagaggggagccgcgggcgccgtgg gtggagcaggaggggccggagtattgggaccgggagacacagaagtacaagcgccaggcacagactgaccgagtga acctgcggaaactgcgcggctactacaaccagagcgaggccgggtctcacaccctccagaggatgtatggctgcga cctggggcccgacgggcgcctcctccgcgggtataaccagttcgcctacgacggcaaggattacatcgccctgaat gaggacctgcgctcctggaccgccgcggacaaggcggctcagatcacccagcgcaagtgggaggcggcccgtgagg cggagcagcggagagcctacctggagggcatgtgcgtggagtggctGcgcagatacctggagaacgggaaggagac gctgcagcgcgcgg;

Cw*0503:

(SEQ ID NO: 1700)

atgcgggtcatggcgccccgaaccctcatcctgctgctctcgggagccctggccctgaccgagacctgggcctgct cccactccatgaggtatttctacaccgccgtgtcccggcccggccgcggagagccccgcttcatcgcagtgggcta cgtggacgacacgcagttcgtgcagttcgacagcgacgccgcgagtccaagaggggagccgcgggcgccgtgggtg gagcaggaggggccggagtattgggaccgggagacacagaagtacaagcgccaggcacagactgaccgagtgaacc tgcggaaactgcgcggctactacaaccagagcgaggccgggtctcacaccctccagaggatgtatggctgcgacct ggggcccgacgggcgcctcctccgcgggtataaccagttcgcctacgacggcaaggattacatcgccctgaatgag gacctgcgctcctggaccgccgcggacaaggcggctcagatcacccagcgcaagtgggaggcggcccgtgaggcgg agcagcggagagcctacctggagggcacgtgcgtggagtggctccgcagatacctggagaacgggaagaagacgct gcagcgcgcggaccccccaaagacacatgtgacccaccacccatctctgaccatgaggTcaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccagagcccctcaccctgagatggggGccatcttcccagccc accatccccatcgtgggcatcgttgctggcctggctgtcctggctgtcctagctgtcctaggagctgtgatggctg ttgtgatgtgtaggaggaagagctcaggtggaaaaggagggagctgctctcaggctgcgtccagcaacagtgccca gggctctgatgagtctctcatcgcttgtaa;

Cw*0504:

(SEQ ID NO: 1701)

gctcccactccatgaggtatttctacaccgccgtgtcccggcccggccgcggagagccccgcttcatcgcagtggg ctacgtggacgacacgcagttcgtgcagttcgacagcgacgccgcgagtccaagaggggagccgcgggcgccgtgg gtggagcaggaggggccggagtattgggaccgggagacacagaagtacaagcgccaggcacagactgaccgagtga acctgcggaaactgcgcggctactacaaccagagcgaggccgggtctcacaccctccagaggatgtatggctgcga cctggggcccgacgggcgcctcctccgcgggtatgaccagtCcgcctacgacggcaaggattacatcgccctgaat gaggacctgcgctcctggaccgccgcggacaAggcggctcagatcacccagcgcaagtgggaggcggcccgtgagg -continued cggagcagcggagagcctacctggagggcacgtgcgtggagtggctccgcagatacctggagaacgggaagAagac gctgcagcgcgcgg;

Cw*0505:
(SEQ ID NO: 1702)
gctcccactccatgaggtatttctacaccgccgtgtcccggcccggccgcggagagccccgcttcatcgcagtggg ctacgtggacgacacgcagttcgtgcagttcgacagcgacgccgcgagtccaagaggggagccgcgggcgccgtgg gtggagcaggaggggccggagtattgggaccgggagacacagaagtacaagcgccaggcacagactgaccgagtga acctgcggaaactgcgcggctactacaaccagagcgaggcccgggtctcacaccctccagaggatgtatggctgcga cGtggggcccgacgggcgcctcctccgcgggtataaccagtTcgcctacgacggcaaggattacatcgccctgaat gaggacctgcgctcctggaccgccgcggacaAggcggctcagatcacccagcgcaagtgggaggcggcccgtgagg cggagcagcggagagcctacctggagggcacgtgcgtggagtggctccgcagatacctggagaacgggaagAagac gctgcagcgcgcgg;

Cw*0506:
(SEQ ID NO: 1703)
gctcccactccatgaggtatttctacaccgccgtgtcccggcccggccgcggagagccccgcttcatcgcagtggg ctacgtggacgacacgcagttcgtgcagttcgacagcgacgccgcgagtccaagaggggagccgcgggcgcGgtgg gtggagcaggaggggccggagtattgggaccgggagacacagaagtacaagcgccaggcacagactgaccgagtga acctgcggaaactgcgcggctactacaaccagagcgaggcccgggtctcacaccctccagaggatgtatggctgcga cctggggcccgacgggcgcctcctccgcgggtataaccagttcgcctacgacggcaaggattacatcgccctgaat gaggacctgcgctcctggaccgccgcggacaaggcggctcagatcacccagcgcaagtgggaggcggcccgtgagg cggagcagcggagagcctacctggagggcacgtgcgtggagtggctccgcagatacctggagaacgggaagaagac gctgcagcgcgcgg;

Cw*0602:
(SEQ ID NO: 1704)
atgcgggtcatggcgccccgaaccctcatcctgctgctctcgggagccctggccctgaccgagacctgggcctgct cccactccatgaggtatttcgacaccgccgtgtcccggcccggccgcggagagccccgcttcatctcagtgggcta cgtggacgacacgcagttcgtgcggttcgacagcgacgccgcgagtccgagaggggagccCgggcgccgtgggtg gagcaggaggggccggagtattgggaccgggagacacagaagtacaagcgccaggcacaggctgaccgagtgaacc tgcggaaactgcgcggctactacaaccagagcgaggacgggtctcacaccctccagtggatgtatggctgcgacct ggggcccgacgggcgcctcctccgcgggtatgaccagtccgcctacgacggcaaggattacatcgccctgaacgag gacctgcgctcctggaccgccgcggacacggcggctcagatcacccagcgcaagtgggaggcggcccgtgaggcgg agcagTggagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccagagcccctcaccctgagatgggagccatcttcccagccc accatccccatcgtgggcatcgttgctggcctggctgtcctggctgtcctagctgtcctaggagctgtgAtggctg ttgtgatgtgtaggaggaagagctcaggtggaaaaggagggagctgctctcaggctgcgtccagcaacagtgccca gggctctgatgagtctctcatcgcttgtaa;

Cw*0603:
(SEQ ID NO: 1705)
gctcccactccatgaggtatttctacaccgcTgtgtcccggcccggccgcggagagccccgcttcatctcagtggg ctacgtggacgacacgcagttcgtgcggttcgacagcgacgccgcgagtccgagaggggagccCgggcgccgtgg gtggagcaggaggggccggagtattgggaccgggagacacagaagtacaagcgccaggcacaggctgaccgagtga

```
acctgcggaaactgcgcggctactacaaccagagcgaggacgggtctcacaccctccagtggatgtatggctgcga
cctggggcccgacgggcgcctcctccgcgggtatgaccagtCcgcctacgacggcaaggattacatcgccctgaac
gaggacctgcgctcctggaccgccgcggacacggcggctcagatcacccagcgcaagtgggaggcggcccgtgagg
cggagcagTggagagcctacctggagggcacgtgcgtggagtggctccgcagatacctggagaacgggaaggagac
gctgcagcgcgcgg;
```

Cw*0604:
(SEQ ID NO: 1706)
```
gctcccactccatgaggtatttcgacaccgccgtgtcccggcccggccgcggagagccccgcttcatctcagtggg
ctacgtggacgacacgcagttcgtgcggttcgacagcgacgccgcgagtccgagaggggagccCcgggcgccgtgg
gtggagcaggaggggccggagtattgggaccgggagacacagaagtacaagcgccaggcacaggctgaccgagtga
acctgcggaaactgcgcggctactacaaccagagcgaggacgggtctcacaccctccagtggatgtatggctgcga
cctggggcccgacgggcgcctcctccgcgggtatgaccagtccgcctacgacggcaaggattacatcgccctgaac
gaggacctgcgctcctggaccgccgcggacacggcggctcagatcacccagcgcaagtgggaggcggcccgtgagg
cggagcagcTgagagcctacctggagggcacgtgcgtggagtggctccgcagatacctggagaacgggaaggagac
gctgcagcgcgcgg;
```

Cw*0605:
(SEQ ID NO: 1707)
```
gctcccactccatgaggtatttcgacaccgccgtgtcccggcccggccgcggagagccccgcttcatctcagtggg
ctacgtggacgacacgcagttcgtgcggttcgacagcgacgccgcgagtccAagaggggagccCcgggcgccgtgg
gtggagcaggaggggccggagtattgggaccgggagacacagaagtacaagcgccaggcacagactgaccgagtga
acctgcggaaactgcgcggctactacaaccagagcgaggacgggtctcacaccctccagtggatgtatggctgcga
cctggggcccgacgggcgcctcctccgcgggtatgaccagtCcgcctacgacggcaaggattacatcgccctgaac
gaggacctgcgctcctggaccgccgcggacacGgcggctcagatcacccagcgcaagtgggaggcggcccgtgagg
cggagcagcggagagcctacctggagggcacgtgcgtggagtggctccgcagatacctggagaacgggaaggagac
gctgcagcgcgcgg;
```

Cw*0606:
(SEQ ID NO: 1708)
```
gctcccactccatgaggtatttcgacaccgccgtgtcccggcccggccgcggagagccccgcttcatctcagtggg
ctacgtggacgacacgcagttcgtgcggttcgacagcgacgccgcgagtccgagaggggagccCcgggcgccgtgg
gtggagcaggaggggccggagtattgggaccgggagacacagaagtacaagcgccaggcacaggctgaccgagtga
acctgcggaaactgcgcggctactacaaccagagcgaggacgggtctcacaccctccagtggatgtatggctgcga
cctggggcccgacgggcgcctcctccgcgggtatgaccagtccgcctacgacggcaaggattacatcgccctgaac
gaggacctgcgctcctggaccgccgcggacacggcggctcagatcacccagcgcaagtgggaggcggcccgtgagg
cggagcagcggagagcctacctggagggcacgtgcgtggagtggctccgcagatacctggagaacgggaaggagac
gctgcagcgcgcggaacacccaaagacacacgtgacccaccatcccgtctctgaccatgaggccaccctgaggtgc
tgggccctgggcttctaccctgcggagatcacactgacctggcagcgggatggcgaggaccaaactcaggacaccg
agcttgtggagaccaggccagcaggagatggaaccttccagaagtgggcagctgtggtggtgcccttctggagaaga
gcagagatacacgtgccatgtgcagcacgaggggctgccagagcccctcaccctgagatgggagccatcttcccag
cccaccatccccatcgtgggcatcgttgctggcctggctgtcctggctgtcctagctgtcctaggagctgtgAtgg
ctgttgtgatgtgtaggaggaagagctcag;
```

Cw*0607:
(SEQ ID NO: 1709)
```
gctcccactccatgaggtatttcgacaccgccgtgtcccggcccggccgcggagagccccgcttcatctcagtggg
ctacgtggacgacacgcagttcgtgcggttcgacagcgacgccgcgagtccgagaggggagccccgggcgccgtgg
gtggagAaggaggggccggagtattgggaccgggagacacagaagtacaagcgccaggcacaggctgaccgagtga
```

-continued acctgcggaaactgcgcggctactacaaccagagcgaggacgggtctcacaccctccagtggatgtatggctgcga
cctggggcccgacgggcgcctcctccgcgggtatgaccagtccgcctacgacggcaaggattacatcgccctgaac
gaggacctgcgctcctggaccgccgcggacacggcggctcagatcacccagcgcaagtgggaggcggcccgtgagg
cggagcagtggagagcctacctggagggcacgtgcgtggagtggctccgcagatacctggagaacgggaaggagac
gctgcagcgcgcgcgg;

Cw*0608:
(SEQ ID NO: 1710)
gctcccactccatgaggtatttcgacaccgccgtgtcccggcccggccgcggagagccccgcttcatctcagtggg
ctacgtggacgacacgcagttcgtgcggttcgacagcgacgccgcgagtccgagaggggagcccgggcgccgtgg
gtggagcaggaggggccggagtattgggaccgggagacacagaagtacaagcgccaggcacaggctgaccgagtga
acctgcggaaactgcgcggctactacaaccagagcgaggAcgggtctcacaccctccagtggatgtatggctgcga
cctggggcccgacgggcgcctcctccgcgggtatgaccagtCcgcctacgacggcaaggattacatcgccctgaac
gaggacctgcgctcctggaccgccgcggacacGgcggctcagatcacccagcgcaagtgggaggcggcccgtgagg
cggagcagTggagagcctacctggagggcgAgtgcgtggagtggctccgcagatacctggagaacgggaaggagac
gctgcagcgcgcgcgg;

Cw*0609:
(SEQ ID NO: 1711)
gctcccactccatgaggtatttcgacaccgccgtgtcccggcccggccgcggagagccccgcttcatctcagtggg
ctacgtggacgacacgcagttcgtgcggttcgacagcgacgccgcgagtccgagaggggagccCcgggcgccgtgg
gtggagcaggaggggccggagtattgggaccgggagacacagaagtacaagcgccaggcacaggctgaccgagtga
acctgcggaaactgcgcggctactacaaccagagcgaggacgggtctcacaccctccagtggatgtatggctgcga
cctggggcccgacgggcgcctcctccgcgggtataaccagtTcgcctacgacggcaaggattacatcgccctgaac
gaggacctgcgctcctggaccgccgcggacacggcggctcagatcacccagcgcaagtgggaggcggcccgtgagg
cggagcagTggagagcctacctggagggcacgtgcgtggagtggctccgcagatacctggagaacgggaaggagac
gctgcagcgcgcgcgg;

Cw*070101:
(SEQ ID NO: 1712)
atgcgggtcatggcgccccgagccctcctcctgctgctctcggggaggcctggccctgaccgagacctgggcctgct
cccactccatgaggtatttcgacaccgccgtgtcccggcccggccgcggagagccccgcttcatctcagtgggcta
cgtggacgacacgcagttcgtgcggttcgacagcgacgccgcgagtccgagaggggagccgggcgccgtggtg
gagcaggaggggccggagtattgggaccgggagacacagaactacaagcgccaggcacaggctgaccgagtgagcc
tgcggaacctgcgcggctactacaaccagagcgaggacgggtctcacaccctccagaggatgtAtggctgcgacct
ggggcccgacgggcgcctcctccgcgggtatgaccagtccgcctacgacggcaaggattacatcgccctgaacgag
gacctgcgctcctggaccgccgcggacaccgcggctcagatcacccagcgcaagtTggaggcggcccgtgcggcgg
agcagctgagagcctacctggagggcacgtgcgtggagtggctccgcagatacctggagaacgggaaggagacgct
gcagcgcgcAgaaccccaaagacacacgtgacccaccacccccctctctgaccatgaggccaccctgaggtgctgg
gccctgggcttctaccctgcggagatcacactgacctggcagcgggatgggaggaccagacccaggacaccgagc
ttgtggagaccaggccagcaggagatggaaccttccagaagtgggcagctgtggtggtgccttctggacaagagca
gagatacacgtgccatatgcagcacgaggggctgcaagagccctcaccctgagctgggagccatcttcccagccc
accatcccatcatgggcatcgttgctggcctggctgtcctggttgtcctagctgtccttggagctgtggtcaccg
ctatgatgtgtaggaggaagagctcaggtggaaaaggagggagctgctctcaggctgcgtgcagcaacagtgccca
gggctctgatgagtctctcatcActtgtaa;

Cw*070102:

(SEQ ID NO: 1713)

atgcgggtcatggcgcccgagccctcctcctgctgctctcggggaggcctggccctgaccgagacctgggcctgct cccactccatgaggtatttcgacaccgccgtgtcccggcccggccgcggagagccccgcttcatctcagtgggcta cgtggacgacacgcagttcgtgcggttcgacagcgacgccgcgagtccgagaggggagccgcgggcgccgtgggtg gagcaggaggggccggagtattgggaccgggagacacagaactacaagcgccaggcacaggctgaccgagtgagcc tgcggaacctgcgcggctactacaaccagagcgaggacgggtctcacaccctccagaggatgtatggctgcgacct ggggcccgacgggcgcctcctccgcgggtatgaccagtccgcctacgacggcaaggattacatcgccctgaacgag gacctgcgctcctggaccgccgcggacaccgcggctcagatcacccagcgcaagttggaggcggcccgtgcggcgg agcagctgagagcctacctggagggcacgtgcgtggagtggctccgcagatacctggagaacgggaaggagacgct gcagcgcgcagaaccccaaagacacacgtgacccaccaccccctctctgaccatgaggccaccctgaggtgctgg gccctgggcttctaccctgcggagatcacactgacctggcagcgggatggggaggaccagacccaggacaccgagc ttgtggagaccaggccagcaggagatggaaccttccagaagtgggcagctgtggtggtgccttctggacaagagca gagatacacgtgccatatgcagcacgaggggctgcaagagcccctcaccctgagctgggagccatcttcccagccT accatccccatcatgggcatcgttgctggcctggctgtcctggttgtcctagctgtccttggagctgtggtcaccg ctatgatgtgtaggaggaagagctcaggtggaaaaggagggagctgctctcaggctgcgtgcagcaacagtgccca gggctctgatgagtctctcatcacttgtaa;

Cw*070201:

(SEQ ID NO: 1714)

atgcgggtcatggcgcccgagccctcctcctgctgctctcggggaggcctggccctgaccgagacctgggcctgct cccactccatgaggtatttcgacaccgccgtgtcccggcccggccgcggagagccccgcttcatctcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacaggctgaccgagtgagcc tgcggaacctgcgcggctactacaaccagagcgaggacgggtctcacaccctccagaggatgtCtggctgcgacct ggggcccgacgggcgcctcctccgcgggtatgaccagtccgcctacgacggcaaggattacatcgccctgaacgag gacctgcgctcctggaccgccgcggacaccgcggctcagatcacccagcgcaagtTggaggcggcccgtgcggcgg agcagctgagagcctacctggagggcacgtgcgtggagtggctccgcagatacctggagaacgggaaggagacgct gcagcgcgcagaaccccaaagacacacgtgacccaccaccccctctctgaccatgaggccaccctgaggtgctgg gccctgggcttctaccctgcggagatcacactgacctggcagcgggatggggaggaccagacccaggacaccgagc ttgtggagaccaggccagcaggagatggaaccttccagaagtgggcagctgtggtggtgccttctggacaagagca gagatacacgtgccatatgcagcacgaggggctgcaagagcccctcaccctgagctgggagccatcttcccagccc accatccccatcatgggcatcgttgctggcctggctgtcctggttgtcctagctgtccttggagctgtggtcaccg ctatgatgtgtaggaggaagagctcaggtggaaaaggagggagctgctctcaggctgcgtgcagcaacagtgccca gggctctgatgagtctctcatcActtgtaa;

Cw*0703:

(SEQ ID NO: 1715)

tgctcccactccatgaggtatttcgacaccgccgtgtcccggcccggcgccggagagccccgcttcatctcagtgg gctacgtggacgacacgcagttcgtgcggttcgacagcgacgccgcgagtccgagaggggagccgcgggcgccgtg ggtggagcaggaggggccggagtattgggaccgggagacacagaagtacaagcgccaggcacaggctgaccgagtg agcctgcggaacctgcgcggctactacaaccagagcgaggacgggtctcacaccctccagaggatgtctggctgcg acctggggcccgacgggcgcctcctccgcgggtatgaccagtccgcctacgacggcaaggattacatcgccctgaa cgaggacctgcgctcctggaccgcggcggacaccgcggctcagatcacccagcgcaagtgggaggcggcccgtgcg gcggagcagctgagagcctacctggagggActgtgcgtggagtggctccgcagatacctggagaacgggaaggaga -continued cgctgcagcgcgcagaacccccaaagacacacgtgacccaccacccctctctgaccatgaggccaccctgaggtg ctgggccctgggcttctaccctgcggagatcacactgacctggcagcggatggggaggaccagacccaggacacc gagcttgtggagaccaggccagcaggagatggaaccttccagaagtgggcagctgtggtggtgccttctggacaag agcagagatacacgtgccatatgcagcacgaggggctgcaagagcccctcaccctgagctgggagccatcttccca gcccaccatcccatcatgggcatcgttgctggcctggctgtcctggttgtcctagctgtccttggagctgtggtc accgctatgatgtgtaggaggaagagctcaggtggaaaaggagggagctgctctcaggctgcgtgcagcaacagtg cccagggctctgatgagtctctcatcacttgtaa;

Cw*070401:

(SEQ ID NO: 1716)

atgcgggtcatggcgccccgagccctcctcctgctgctctcggggaggcctggccctgaccgagacctgggcctgct cccactccatgaggtatttcgacaccgccgtgtcccggcccggccgcggagagccccgcttcatctcagtgggcta cgtggacgacacgcagttcgtgcggttcgacagcgacgccgcgagtccgagaggggagcccgggcgccgtgggtg gagcaggaggggccggagtattgggaccgggagacacagaagtacaagcgccaggcacaggctgaccgagtgagcc tgcggaacctgcgcggctactacaaccagagcgaggacgggtctcacaccttccagaggatgtatggctgcgacct ggggcccgacgggcgcctcctccgcgggtatgaccagttcgcctacgacggcaaggattacatcgccctgaacgag gacctgcgctcctggaccgccgcggacaccgcggctcagatcacccagcgcaagttggaggcggcccgtgcggcgg agcaggaCagagcctacctggagggcacgtgcgtggagtggctccgcagatacctggagaacgggaagaagacgct gcagcgcgcggaaccccaaagacacacgtgacccaccacccctctctgaccatgaggccaccctgaggtgctgg gccctgggcttctaccctgcggagatcacactgacctggcagcgggatggggaggaccagacccaggacaccgagc ttgtggagaccaggccagcaggagatggaaccttccagaagtgggcagctgtggtggtgccttctggacaagagca gagatacacgtgccatatgcagcacgaggggctgcaagagcccctcaccctgagctgggagccatcttcccagccc accatcccatcatgggcatcgttgctggcctggctgtcctggttgtcctagctgtccttggagctgtggtcaccg ctatgatgtgtaggaggaagagctcaggtggaaaaggagggagctgctctcaggctgcgtgcagcaacagtgccca gggctctgatgagtctctcatcActtgtaa;

Cw*070402:

(SEQ ID NO: 1717)

atgcgggtcatggcgccccgagccctcctcctgctgctctcggggaggcctggccctgaccgagacctgggcctgct cccactccatgaggtatttcgacaccgccgtgtcccggcccggccgcggagagccccgcttcatctcagtgggcta cgtggacgacacgcagttcgtgcggttcgacagcgacgccgcgagtccgagaggggagcccgggcgccgtgggtg gagcaggaggggccggagtattgggaccgggagacacagaagtacaagcgccaggcacaggctgaccgagtgagcc tgcggaacctgcgcggctactaTaaccagagcgaggacgggtctcacaccttccagaggatgtatggctgcgacct ggggcccgacgggcgcctcctccgcgggtatgaccagttcgcctacgacggcaaggattacatcgccctgaacgag gacctgcgctcctggaccgccgcggacaccgcggctcagatcacccagcgcaagttggaggcggcccgtgcggcgg agcaggacagagcctacctggagggcacgtgcgtggagtggctccgcagatacctggagaacgggaagaagacgct gcagcgcgcggaaccccaaagacacacgtgacccaccacccctctctgaccatgaggccaccctgaggtgctgg gccctgggcttctaccctgcggagatcacactgacctggcagcgggatggggaggaccagacccaggacaccgagc ttgtggagaccaggccagcaggagatggaaccttccagaagtgggcagctgtggtggtgccttctggacaagagca gagatacacgtgccatatgcagcacgaggggctgcaagagcccctcaccctgagctgggagccatcttcccagccc accatcccatcatgggcatcgttgctggcctggctgtcctggttgtcctagctgtccttggagctgtggtcaccg ctatgatgtgtaggaggaagagctcaggtggaaaaggagggagctgctctcaggctgcgtgcagcaacagtgccca gggctctgatgagtctctcatcacttgtaa;

Cw*0705:

(SEQ ID NO: 1718)
gctcccactccatgaggtatttcgacaccgccgtgtcccggcccggccgcggagagccccgcttcatctcagtggg
ctacgtggacgacacgcagttcgtgcggttcgacagcgacgccgcgagtccgagaggggagccgcgggcgccgtgg
gtggagcaggaggggccggagtattgggaccgggagacacagaagtacaagcgccaggcacaggctgaccgagtga
gcctgcggaacctgcgcggctactacaaccagagcgaggacgggtctcacaccctccagaaTatgtatggctgcga
cctggggcccgacgggcgcctcctccgcgggtatgaccagtccgcctacgacggcaaggattacatcgccctgaac
gaggacctgcgctcctggaccgccgcggacaccgcggctcagatcacccagcgcaagttggaggcggcccgtgcgg
cggagcagctgagagcctacctggagggcacgtgcgtggagtggctccgcagatacctggagaacgggaaggagac
gctgcagcgcgcag;

Cw*0706:

(SEQ ID NO: 1719)
atgcgggtcatggcgccccgagccctcctcctgctgctctcggggaggcctggccctgaccgagacctgggcctgct
cccactccatgaggtatttcgacaccgccgtgtcccggcccggccgcggagagccccgcttcatctcagtgggcta
cgtggacgacacgcagttcgtgcggttcgacagcgacgccgcgagtccgagaggggagccgcgggcgccgtgggtg
gagcaggaggggccggagtattgggaccgggagacacagaactacaagcgccaggcacaggctgaccgagtgagcc
tgcggaacctgcgcggctactacaaccagagcgaggacgggtctcacaccctccagaggatgtatggctgcgacct
ggggcccgacgggcgcctcctccgcgggtatgaccagtccgcctacgacggcaaggattacatcgccctgaacgag
gacctgcgctcctggaccgccgcggacaccgcggctcagatcacccagcgcaagttggaggcggcccgtgcggcgg
agcagctgagagcctacctggagggcacgtgcgtggagtggctccgcagatacctggagaacgggaaggagacgct
gcagcgcgcagaacccccaaagacacacgtgacccaccaccccctctctgaccatgaggccaccctgaggtgctgg
gccctgggcttctaccctgcggagatcacactgacctggcagcgggatgggggaggaccagacccaggacaccgagc
ttgtggagaccaggccagcaggagatggaaccttccagaagtgggcagctgtggtggtgccttctggacaagagca
gagatacacgtgccatatgcagcacgaggggctgcaagagccccteaccctgagctgggagccatcttcccagccc
accatccccatcatgggcatcgttgctggcctggctgtcctggttgtcctagctgtccttggagctgtggtcaccg
ctaAgatgtgtaggaggaagagctcaggtggaaaaggagggagctgctctcaggttgcgtgcagcaacagtgccca
gggctctgatgagtctctcatcacttgtaa;

Cw*0707:

(SEQ ID NO: 1720)
gctcccactccatgaggtatttcgacaccgccgtgtcccggcccggccgcggagagccccgcttcatctcagtggg
ctacgtggacgacacgcagttcgtgcggttcgacagcgacgccgcgagtccgagaggggagccgcgggcgccgtgg
gtggagcaggaggggccggagtattgggaccgggagacacagaactacaagcgccaggcacaggctgaccgagtga
acctgcggaaActgcgcggctactacaaccagagcgaggccgggtctcacaccctccagaggatgtAtggctgcga
cctggggcccgacgggcgcctcctccgcgggtatgaccagtCcgcctacgacggcaaggattacatcgccctgaac
gaggacctgcgctcctggaccgccgcggacaccgcggctcagatcacccagcgcaagtTggaggcggcccgtgcgg
cggagcagctgagagcctacctggagggcacgtgcgtggagtggctccgcagatacctggagaacgggaaggagac
gctgcagcgcgcAg;

Cw*0708:

(SEQ ID NO: 1721)
gctcccactccatgaggtatttcgacaccgccgtgtcccggcccggccgcggagagccccgcttcatctcagtggg
ctacgtggacgacacgcagttcgtgcggttcgacagcgacgccgcgagtccgagaggggagccgcgggcgccgtgg
gtggagcaggaggggccggagtattgggaccgggagacacagaagtacaagcgccaggcacaggctgaccgagtga
gcctgcggaacctgcgcggctactacaaccagagcgaggacgggtctcacaccctccagaggatgtTtggctgcga
cctggggcccgacgggcgcctcctccgcgggtatgaccagtCcgcctacgacggcaaggattacatcgccctgaac -continued gaggacctgcgctcctggaccgccgcggacaccgcggctcagatcacccagcgcaagtTggaggcggcccgtgcgg cggagcagctgagagcctacctggagggcacgtgcgtggagtggctccgcagatacctggagaacgggaaggagac gctgcagcgcgcAg;

Cw*0709:

(SEQ ID NO: 1722)

gctcccactccatgaggtatttcgacaccgccgtgtcccggcccggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaactacaagcgccaggcacaggctgaccgagtga acctgcggaaActgcgcggctactacaaccagagcgaggAcgggtctcacaccctccagaggatgtAtggctgcga cctggggcccgacgggcgcctcctccgcgggtatgaccagtCcgcctacgacggcaaggattacatcgccctgaac gaggacctgcgctcctggaccgccgcggacaccgcggctcagatcacccagcgcaagtTggaggcggcccgtgcgg cggagcagctgagagcctacctggagggcacgtgcgtggagtggctccgcagatacctggagaacgggaaggagac gctgcagcgcgcAg;

Cw*0710:

(SEQ ID NO: 1723)

gctcccactccatgaggtatttcgacaccgccgtgtcccggcccggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacaggctgaccgagtga gcctgcggaacctgcgcggctactacaaccagagcgaggacgggtctcacatcAtccagaggatgtCtggctgcga cctggggcccgacgggcgcctcctccgcgggtatgaccagtCcgcctacgacggcaaggattacatcgccctgaac gaggacctgcgctcctggaccgccgcggacaccgcggctcagatcacccagcgcaagtTggaggcggcccgtgcgg cggagcagctgagagcctacctggagggcacgtgcgtggagtggctccgcagatacctggagaacgggaaggagac gctgcagcgcgcAg;

Cw*0711:

(SEQ ID NO: 1724)

atgcgggtcatggcgccccgagccctcctcctgctgctctcggaggcctggcccctgaccgagacctgggcctgct cccactccatgaggtatttcgacaccgccgtgtcccggcccggccgcggagagccccgcttcatctcagtgggcta cgtggacgacacgcagttcgtgcggttcgacagcgacgccgcgagtccgagaggggagccccgggcgccgtgggtg gagcaggaggggccggagtattgggaccgggagacacagaagtacaagcgccaggcacaggctgaccgagtgagcc tgcggaacctgcgcggctactacaaccagagcgaggacgggtctcacaccttccagaggatgtatggctgcgacct ggggcccgacgggcgcctcctccgcgggtatgaccagttcgcctacgacggcaaggattacatcgccctgaacgag gacctgcgctcctggaccgccgcggacaccgcggctcagatcacccagcgcaagttggaggcggcccgtgcggcgg agcaggaCagagcctacctggagggcacgtgcgtggagtggctccgcagatacctggagaacgggaagaagacgct gcagcgcgcggaaccccaaagacacacgtgacccaccaccccctctctgaccatgaggccaccctgaggtgctgg gccctgggcttctaccctgcggagatcacactgacctggcagcgggatggggaggaccagacccaggacaccgagc ttgtggagaccaggccagcaggagatggaaccttccagaagtgggcagctgtggtggtgccttctggacaagagca gagatacacgtgccatatgcagcacgaggggctgcaagagcccctcaccctgagctgggagccatcttcccagccc accatccccatcatgggcatcgttgctggcctggctgtcctggttgtcctagctgtccttggagctgtggtcaccg ctatgatgtgtaggaggaagagctcaggtggaaaaggagggagctgctctcaggctgcgtGcagcaacagtgccca gggctctgatgagtctctcatcgcttgtaa;

Cw*0712:

(SEQ ID NO: 1725)

gctcccactccatgaggtatttcgacaccgccgtgtcccggcccggccgcggagagccccgcttcatctcagtggg ctacgtggacgacacgcagttcgtgcggttcgacagcgacgccgcgagtccgagaggggagccccgggcgccgtgg gtggagcaggaggggccggagtattgggaccgggagacacagaagtacaagcgccaggcacaggctgaccgagtga -continued gcctgcggaacctgcgcggctactacaaccagagcgaggacgggtctcacaccttccagaggatgtatggctgcga cctggggcccgacgggcgcctcctccgcgggtatgaccagttcgcctacgacggcaaggattacatcgccctgaac gaggacctgcgctcctggaccgccgcggacaccgcggctcagatcacccagcgcaagtgggaggcggcccgtgcgg cggagcaggaCagagcctacctggagggcacgtgcgtggagtggctccgcagatacctggagaacgggaagaagac gctgcagcgcgcgcgg;

Cw*0713:
(SEQ ID NO: 1726)
gctcccactccatgaggtatttcgacaccgccgtgtcccggcccggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacaggctgaccgagtga gcctgcggaacctgcgcggctactacaaccagagcgaggacgggtctcacaccctccagaggatgtCtggctgcga cctggggcccgacgggcgcctcctccgcgggtatgaccagtTcgcctacgacggcaaggattacatcgccctgaac gaggacctgcgctcctggaccgccgcggacaccgcggctcagatcacccagcgcaagtTggaggcggcccgtgcgg cggagcagctgagagcctacctggagggcacgtgcgtggagtggctccgcagatacctggagaacgggaaggagac gctgcagcgcgcAg;

Cw*0714:
(SEQ ID NO: 1727)
gctcccactccatgaggtatttcgacaccgccgtgtcccggcccggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacaggctgaccgagtga gcctgcggaacctgcgcggctactacaaccagagcgaggacgggtctcacaccctccagaggatgtacggctgcga cctggggcccgacgggcgcctcctccgcgggtatgaccagtccgcctacgacggcaaggattacatcgccctgaac gaggacctgcgctcctggaccgccgcggacaccgcggctcagatcacccagcgcaagttggaggcggcccgtgcgg cggagcagctgagagcctacctggagggcacgtgcgtggagtggctccgcagatacctggagaacgggaaggagac gctgcagcgcAcag;

Cw*0715:
(SEQ ID NO: 1728)
gctcccactccatgaggtatttcgacaccgccgtgtcccggcccggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacaggctgaccgagtga gcctgcggaacctgcgcggctactacaaccagagcgaggacgggtctcacaccctccagaggatgtCtggctgcga cctggggcccgacgggcgcctcctccgcgggtatgaccagtccgcctacgacggcaaggattacatcgccctgaac gaggacctgcgctcctggaccgccgcggacaccgcggctcagatcacccagcgcaagttggaggcggcccgtgcgg cggagcagctgagagcctacctggagggcgAgtgcgtggagtggctccgcagatacctggagaacgggaaggagac gctgcagcgcgcAg;

Cw*0716:
(SEQ ID NO: 1729)
gctcccactccatgaggtatttcgacaccgccgtgtcccggcccggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaaCtacaagcgccaggcacaggctgaccgagtga gcctgcggaacctgcgcggctactacaaccagagcgaggccgggtctcacaccctccagaggatgtAtggctgcga cctggggcccgacgggcgcctcctccgcgggtatgaccagtCcgcctacgacggcaaggattacatcgccctgaac gaggacctgcgctcctggaccgccgcggacaccgcggctcagatcacccagcgcaagtTggaggcggcccgtgcgg cggagcagctgagagcctacctggagggcacgtgcgtggagtggctccgcagatacctggagaacgggaaggagac gctgcagcgcgcAg;

Cw*0717:

(SEQ ID NO: 1730)

gctcccactccatgaggtatttcgacaccgccgtgtcccggcccggccgcggagagccccgcttcatctcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacaggctgaccgagtga gcctgcggaacctgcgcggctactacaaccagagcgaggacgggtctcacaccctccagaggatgtCtggctgcga cctggggcccgacgggcgcctcctccgcgggtatgaccagtccgcctacgacggcaaggattacatcgccctgaac gaggacctgcgctcctggaccgccgcggacaccgcggctcagatcacccagcgcaagtgggaggcggcccgtgcgg cggagcagctgagagcctacctggagggcacgtgcgtggagtggctccgcagatacctggagaacgggaaggagac gctgcagcgcgcagaaccccaaagacacacgtgacccaccacccctctctgaccatgaggccaccctgaggtgc tgggccctgggcttctaccctgcggagatcacactgacctggcagcgggatggggaggaccagacccaggacaccg agcttgtggagaccaggccagcaggagatggaaccttccagaagtgggcagctgtggtggtgccttctggacaaga gcagagatacacgtgccatatgcagcacgaggggctgcaagagcccctcaccctgagCtggg;

Cw*0718:

(SEQ ID NO: 1731)

atgcgggtcatggcgccccgagccctcctcctgctgctctcggggaggcctggccctgaccgagacctgggcctgct cccactccatgaggtatttcgacaccgccgtgtcccggcccggccgcggagagccccgcttcatctcagtgggcta cgtggacgacacgcagttcgtgcggttcgacagcgacgccgcgagtccgagaggggagccgcgggcgccgtgggtg gagcaggaggggccggagtattgggaccgggagacacagaactacaagcgccaggcacaggctgaccgagtgagcc tgcggaacctgcgcggctactacaaccagagcgaggacgggtctcacaccctccagaggatgtatggctgcgacct ggggcccgacgggcgcctcctccgcgggtatgaccagtccgcctacgacggcaaggattacatcgccctgaacgag gacctgcgctcctggaccgccgcggacaccgcggctcagatcacccagcgcaagttggaggcggcccgtgcggcgg agcagctgagagcctacctggagggcacgtgcgtggagtggctccgcagatacctggagaacgggaaggagacgct gcagcgcgcagaaccccaaagacacacgtgacccaccacccctctctgaccatgaggccaccctgaggtgctgg gccctgggcttctaccctgcggagatcacactgacctggcagcgggatggggaggaccagacccaggacaccgagc ttgtggagaccaggccagcaggagatggaaccttccagaagtgggcagctgtggtggtgccttctggacaagagca gagatacacgtgccatatgcagcacgaggggctgcaagagcccctcaccctgagctgggagccatcttcccagccc accatccccatcatgggcatcgttgctggcctggctgtcctggttgtcctagctgtccttggagctgtggtcaccg ctatgatgtgtaggaggaagagctcaggtggaaaaggagggagctgctctcaggTtgcgtgcagcaacagtgccca gggctctgatgagtctctcatcacttgtaa;

Cw*080101:

(SEQ ID NO: 1732)

atgcgggtcatggcgccccgaaccctcatcctgctgctctcgggagccctggccctgaccgagacctgggcctgct cccactccatgaggtatttctacaccgccgtgtcccggcccggccgcggagagccccgcttcatcgcagtgggcta cgtggacgacacgcagttcgtgcagttcgacagcgacgccgcgagtccaagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggccgggtctcacaccctccagaggatgtatggctgcgacct ggggcccgacgggcgcctcctccgcgggtataaccagttcgcctacgacggcaaggattacatcgccctgaatgag gacctgcgctcctggaccgccgcggacacggcggctcagatcacccagcgcaagtgggaggcggcccgtacggcgg agcagcTgagagcctacctggagggcacgtgcgtggagtggctccgcagatacctggagaacgggaagaagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccagagcccctcaccctgagatgggGgccatcttcccagccc accatcccatcgtgggcatcgttgctggcctggctgtcctggctgtcctagctgtcctaggagctgtgatggctg ttgtgatgtgtaggaggaagagctcaggtggaaaaggagggagctgctctcaggctgcgtccagcaacagtgccca gggctctgatgagtctctcatcgcttgtaa;

Cw*080102:

(SEQ ID NO: 1733)

gctcccactccatgaggtatttctacaccgccgtgtcccggcccggccgcggagagccccgcttcatcgcagtggg ctacgtggacgacacgcagttcgtgcagttcgacagcgacgccgcgagtccaagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccgggtctcacaccctccagaggatgtaCggctgcga cctggggcccgacgggcgcctcctccgcgggtataaccagtTcgcctacgacggcaaggattacatcgccctgaat gaggacctgcgctcctggaccgccgcggacacggcggctcagatcacccagcgcaagtgggaggcggcccgtAcgg cggagcagctgagagcctacctggagggcacgtgcgtggagtggctccgcagatacctggagaacgggaagaagac gctgcagcgcgcgcgg;

Cw*0802:

(SEQ ID NO: 1734)

atgcgggtcatggcgccccgaaccctcatcctgctgctctcgggagccctggccctgaccgagacctgggcctgct cccactccatgaggtatttctacaccgccgtgtcccggcccggccgcggagagccccgcttcatcgcagtgggcta cgtggacgacacgcagttcgtgcagttcgacagcgacgccgcgagtccaagaggggagccgcgggcgccgtggtg gagcaggaggggccggagtattgggaccgggagacacagaagtacaagcgccaggcacagactgaccgagtgagcc tgcggaacctgcgcggctactacaaccagagcgaggccgggtctcacaccctccagaggatgtatggctgcgacct ggggcccgacgggcgcctcctccgcgggtataaccagttcgcctacgacggcaaggattacatcgccctgaatgag gacctgcgctcctggaccgccgcggacaAggcggctcagatcacccagcgcaagtgggaggcggcccgtgaggcgg agcagcggagagcctacctggagggcacgtgcgtggagtggctccgcagatacctggagaacgggaagaagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccagagcccctcaccctgagatgggGgccatcttcccagccc accatcccatcgtgggcatcgttgctggcctggctgtcctggctgtcctagctgtcctaggagctgtgatggctg ttgtgatgtgtaggaggaagagctcaggtggaaaaggagggagctgctctcaggctgcgtccagcaacagtgccca gggctctgatgagtctctcatcgcttgtaa;

Cw*0803:

(SEQ ID NO: 1735)

atgcgggtcatggcgccccgaaccctcatcctgctgctctcgggagccctggccctgaccgagacctgggcctgct cccactccatgaggtatttctacaccgccgtgtcccggcccggccgcggagagccccgcttcatcgcagtgggcta cgtggacgacacgcagttcgtgcagttcgacagcgacgccgcgagtccaagaggggagccgcgggcgccgtggtg gagcaggaggggccggagtattgggaccgggagacacagaagtacaagcgccaggcacagactgaccgagtgagcc tgcggaacctgcgcggctactacaaccagagcgaggccgggtctcacaccctccagaggatgtatggctgcgacct ggggcccgacgggcgcctcctccgcgggtataaccagttcgcctacgacggcaaggattacatcgccctgaatgag gacctgcgctcctggaccgccgcggacacggcggctcagatcacccagcgcaagtgggaggcggcccgtacggcgg agcagctgagagcctacctggagggcacgtgcgtggagtggctccgcagatacctggagaacAggaagaagacgct gcagcgcgcggaacacccaaagacacacgtgacccaccatcccgtctctgaccatgaggccaccctgaggtgctgg -continued gccctgggcttctaccctgcggagatcacactgacctggcagcgggatggcgaggaccaaactcaggacaccgagc
ttgtggagaccaggccagcaggagatggaaccttccagaagtgggcagctgtggtggtgccttctggagaagagca
gagatacacgtgccatgtgcagcacgaggggctgccagagcccctcaccctgagatgggggccatcttcccagccc
accatcccatcgtgggcatcgttgctggcctggctgtcctggctgtcctagctgtcctaggagctgtgAtggctg
ttgtgatgtgtaggaggaagagctcaggtggaaaaggagggagctgctctcaggctgcgtccagcaacagtgccca
gggctctgatgagtctctcatcgcttgtaa;

Cw*0804:
(SEQ ID NO: 1736)
gctcccactccatgaggtatttctacaccgccgtgtcccggcccggccgcggagagccccgcttcatcgcagtggg
ctacgtggacgacacgcagttcgtgcagttcgacagcgacgccgcgagtccaagaggggagccgcgggcgccgtgg
gtggagcaggaggggccggagtatttgggaccgggagacacagaagtacaagcgccaggcacagactgaccgagtga
gcctgcggaacctgcgcggctactacaaccagagcgaggcccgggtctcacaccctccagaggatgtatggctgcga
cctggggcccgacgggcgcctcctccgcgggtataaccagttcgcctacgacggcaaggattacatcgccctgaat
gaggacctgcgctcctggaccgccgcggacaAggcggctcagatcacccagcgcaagtgggaggcggcccgtgagg
cggagcagcTgagagcctacctggagggcacgtgcgtggagtggctccgcagatacctggagaacgggaagAagac
gctgcagcgcgcgg;

Cw*0805:
(SEQ ID NO: 1737)
gctcccactccatgaggtatttctacaccgccgtgtcccggcccggccgcggagagccccgcttcatcgcagtggg
ctacgtggacgacacgcagttcgtgcagttcgacagcgacgccgcgagtccaagaggggagccgcgggcgccgtgg
gtggagcaggaggggccggagtatttgggaccgggagacacagaagtacaagcgccaggcacagGctgaccgagtga
gcctgcggaacctgcgcggctactacaaccagagcgaggcccgggtctcacaccctccagaggatgtatggctgcga
cctggggcccgacgggcgcctcctccgcgggtataaccagtTcgcctacgacggcaaggattacatcgccctgaat
gaggacctgcgctcctggaccgccgcggacaAggcggctcagatcacccagcgcaagtgggaggcggcccgtgagg
cggagcagcggagagcctacctggagggcacgtgcgtggagtggctccgcagatacctggagaacgggaagAagac
gctgcagcgcgcgg;

Cw*0806:
(SEQ ID NO: 1738)
gctcccactccatgaggtatttctacaccgccgtgtcccggcccggccgcggagagccccgcttcatcgcagtggg
ctacgtggacgacacgcagttcgtgcagttcgacagcgacgccgcgagtccaagaggggagccgcgggcgccgtgg
gtggagcaggaggggccggagtatttgggaccgggagacacagaagtacaagcgccaggcacagactgaccgagtga
gcctgcggaacctgcgcggctactacaaccagagcgaggcccgggtctcacaccctccagaggatgtatggctgcga
cctggggcccgacgggcgcctcctccgcgggtataaccagttcgcctacgacggcaaggattacatcgccctgaat
gaggacctgcgctcctggaccgccgcggacacggcggctcagatcacccagcgcaagtgggaggcggcccgtacgg
cggagcagctgagagcctacctggagggcGcgtgcgtggagtggctccgcagatacctggagaacAggaagaagac
gctgcagcgcgcgg;

Cw*0807:
(SEQ ID NO: 1739)
gctcccactccatgaggtatttctacaccgccgtgtcccggcccggccgcggagagccccgcttcatcgcagtggg
ctacgtggacgacacgcagttcgtgcagttcgacagcgacgccgcgagtccaagaggggagccgcgggcgccgtgg
gtggagcaggaggggccggagtatttgggaccgggagacacagaagtacaagcgccaggcacagactgaccgagtga
gcctgcggaacctgcgcggctactacaaccagagcgaggcccgggtctcacaccctccagaggatgtatggctgcga
cctggggcccgacgggcgcctcctccgcgggtataaccagttcgcctacgacggcaaggattacatcgccctgaat
gaggacctgcgctcctggaccgccgcggacaAggcggctcagatcacccagcgcaagtTggaggcggcccgtgagg -continued cggagcagcggagagcctacctggagggcacgtgcgtggagtggctccgcagatacctggagaacgggaagAagac gctgcagcgcgcgg;

Cw*0808: (SEQ ID NO: 1740)
gctcccactccatgaggtatttctacaccgccgtgtcccggcccggccgcggagagccccgcttcatcgcagtggg ctacgtggacgacacgcagttcgtgcagttcgacagcgacgccgcgagtccaagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccgggtctcacaccctccagagCatgtatggctgcga cctgggcccgacgggcgcctcctccgcgggtataaccagttcgcctacgacggcaaggattacatcgccctgaat gaggacctgcgctcctggaccgccgcggacacggcggctcagatcacccagcgcaagtgggaggcggcccgtacgg cggagcagctgagagcctacctggagggcacgtgcgtggagtggctccgcagatacctggagaacgggaagAagac gctgcagcgcgcgg;

Cw*0809: (SEQ ID NO: 1741)
atgcgggtcatggcgccccgaaccctcaccctgctgctctcggagccctggccctgaccgagacctgggcctgct cccactccatgaggtatttctacaccgccgtgtcccggcccggccgcggagagccccgcttcatcgcagtgggcta cgtggacgacacgcagttcgtgcagttcgacagcgacgccgcgagtccaagaggggagccgcgggcgccgtgggtg gagcaggagggggccggagtattgggaccgggagacacagaagtacaagcgccaggcacagactgaccgagtgagcc tgcggaacctgcgcggctactacaaccagagcgaggccgggtctcacaccctccagaggatgtatggctgcgacct ggggcccgacgggcgcctcctccgcgggtatgaccagtccgcctacgacggcaaggattacatcgccctgaatgag gacctgcgctcctggaccgccgcggacacggcggctcagatcacccagcgcaagtgggaggcggcccgtacggcgg agcagctgagagcctacctggagggcacgtgcgtggagtggctccgcagatacctggagaacgggGagaagacgct gcagcgcgcggaacacccaaagacacacgtgacccaccatcccgtctctgaccatgaggccaccctgaggtgctgg gcc;

Cw*120201: (SEQ ID NO: 1742)
atgcgggtcatggcgccccgaaccctcatcctgctgctctcggagccctggccctgaccgagacctgggcctgct cccactccatgaggtatttctacaccgccgtgtcccggcccggccgcggagagccccgcttcatcgcagtgggcta cgtggacgacacgcagttcgtgcggttcgacagcgacgccgcgagtccaagaggggagccgcgggcgccgtgggtg gagcaggagggggccggagtattgggaccgggagacacagaagtacaagcgccaggcacaggctgaccgagtgagcc tgcggaacctgcgcggctactacaaccagagcgaggccgggtctcacaccctccagaggatgtaCggctgcgacct ggggcccgacgggcgcctcctccgcgggtatgaccagtccgcctacgacggcaaggattacatcgccctgaacgag gacctgcgctcctggaccgcTgcggacacggcggctcagatcacccagcgcaagtgggaggcggcccgtgaggcgg agcagtggagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccatcttcccagccc accatccccatcgtgggcatcgttgctggcctggctgtcctggctgtcctagctgtcctaggagctgtgAtgctg ttgtgatgtgtaggaggaagagctcaggtggaaaaggagggagctgctctcaggctgcgtccagcaacagtgccca gggctctgatgagtctctcatcgcttgtaa;

Cw*120202: (SEQ ID NO: 1743)
atgcgggtcatggcgccccgaaccctcatcctgctgctctcggagccctggccctgaccgagacctgggcctgct cccactccatgaggtatttctacaccgccgtgtcccggcccggccgcggagagccccgcttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaagtacaagcgccaggcacaggctgaccgagtgagcc tgcggaacctgcgcggctactacaaccagagcgaggccgggtctcacaccctccagaggatgtaCggctgcgacct ggggcccgacgggcgcctcctccgcgggtatgaccagtccgcctacgacggcaaggattacatcgccctgaacgag gacctgcgctcctggaccgcTgcggacacggcggctcagatcacccagcgcaagtgggaggcggcccgtgaggcgg agcagtggagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccAgagcccctcaccctgagatgggagccatcttcccagccc accatccccatcgtgggcatcgttgctggcctggctgtcctggctgtcctagctgtcctaggagctgtgAtggctg ttgtgatgtgtaggaggaagagctcaggtggaaaaggagggagctgctctcaggctgcgtccagcaacagtgccca gggctctgatgagtctctcatcgcttgtaa;

Cw*120203:

(SEQ ID NO: 1744)
gctcccactccatgaggtatttctacaccgccgtgtcccggcccggccgcggagagccccgcttcatcgcagtggg ctacgtggacgacacgcagttcgtgcggttcgacagcgacgccgcgagtccaagaggggagccgcgggcgccgtgg gtggagcaggaggggccggagtattgggaccgggagacacagaagtacaagcgccaggcacaggctgaccgagtga gcctgcggaacctgcgcggctactacaaccagagcgaggccgggtctcacaccctccagaggatgtAtggctgcga cctggggcccgacgggcgcctcctccgcgggtatgaccagtccgcctacgacggcaaggattacatcgccctgaac gaggacctgcgctcctggaccgcTgcggacacggcggctcagatcacccagcgcaagtgggaggcggcccgtgagg cggagcagtggagagcctacctggagggcacgtgcgtggagtggctccgcagatacctggagaacgggaaggagac gctgcagcgcgcgg;

Cw*120301:

(SEQ ID NO: 1745)
atgcgggtcatggcgccccgaaccctcatcctgctgctctcgggagccctggccctgaccgagacctgggcctgct cccactccatgaggtatttctacaccgccgtgtcccggcccggccgcggagagccccgcttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaagtacaagcgccaggcacagGctgaccgagtgagcc tgcggaacctgcgcggctactacaaccagagcgaggccgggtctcacaccctccagtggatgtatggctgcgacct ggggcccgacgggcgcctcctccgcgggtatgaccagtccgcctacgacggcaaggattacatcgccctgaacgag gacctgcgctcctggacTgccgcggacacggcggctcagatcacccagcgcaagtgggaggcggcccgtgaggcgg agcagtggagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccagagcccctcaccctgagatgggagccatcttcccagccc accatccccatcgtgggcatcgttgctggcctggctgtcctggctgtcctagctgtcctaggagctgtgAtggctg ttgtgatgtgtaggaggaagagctcaggtggaaaaggagggagctgctctcaggctgcgtccagcaacagtgccca gggctctgatgagtctctcatcgcttgtaa;

Cw*120302:

(SEQ ID NO: 1746)

gctcccactccatgaggtatttctacaccgccgtgtcccggcccggccgcggagagccccgcttcatcgcagtggg
ctacgtggacgacacgcagttcgtgcggttcgacagcgacgccgcgagtccaagaggggagccgcgggcgccgtgg
gtggagcaggaggggccggagtattgggaccgggagacacagaagtacaagcgccaggcacaggctgaccgagtga
gcctgcggaacctgcgcggctactacaaccagagcgaggccgggtctcacaccctccagtggatgtatggctgcga
cctggggcccgacgggcgcctcctccgcgggtatgaccagtccgcctacgacggcaaggattacatcgccctgaac
gaggacctgcgctcctggaccgcGgcggacacggcggctcagatcacccagcgcaagtgggaggcggcccgtgagg
cggagcagTggagagcctacctggagggcacgtgcgtggagtggctccgcagatacctggagaacgggaaggagac
gctgcagcgcgcgg;

Cw*120401:

(SEQ ID NO: 1747)

atgcgggtcatggcgccccgaaccctcatcctgctgctctcgggagccctggccctgaccgagacctgggcctgct
cccactccatgaggtatttctacaccgccgtgtcccggcccggccgcggagagccccgcttcatcGcagtgggcta
cgtggacgacacgcagttcgtgcggttcgacagcgacgccgcgagtccgagaggggagccgcgggcgccgtgggtg
gagcaggaggggccggagtattgggaccgggagacacagaagtacaagcgccaggcacagGctgaccgagtgaacc
tgcggaaActgcgcggctactacaaccagagcgaggccgggtctcacaccctccagtggatgtAtggctgcgacct
ggggcccgacgggcgcctcctccgcgggtatgaccagtCcgcctacgacggcaaggattacatcgccctgaacgag
gacctgcgctcctggaccgccgcggacacGgcggctcagatcacccagcgcaagtgggaggcggcccgtgaggcgg
agcagTggagagcctacctggagggcacgtgcgtggagtggctccgcagatacctggagaacgggaaggagacgct
gcagcgcgcggaacacccaaagacacacgtgacccaccatcccgtctctgaccatgaggccaccctgaggtgc;

Cw*120402:

(SEQ ID NO: 1748)

atgcgggtcatggcgccccgaaccctcatcctgctgctctcgggagccctggccctgaccgagacctgggcctgct
cccactccatgaggtatttctacaccgccgtgtcccggcccggccgcggagagccccgcttcatcgcagtgggcta
cgtggacgacacgcagttcgtgcggttcgacagcgacgccgcgagtccaagaggggagccgcgggcgccgtgggtg
gagcaggaggggccggagtattgggaccgggagacacagaagtacaagcgccaggcacagGctgaccgagtgaacc
tgcggaaActgcgcggctactacaaccagagcgaggccgggtctcacaccctccagtggatgtatggctgcgacct
ggggcccgacgggcgcctcctccgcgggtatgaccagtccgcctacgacggcaaggattacatcgccctgaacgag
gacctgcgctcctggacTgccgcggacacggcggctcagatcacccagcgcaagtgggaggcggcccgtgaggcgg
agcagtggagagcctacctggagggcacgtgcgtggagtggctccgcagatacctggagaacgggaaggagacgct
gcagcgcgcggaacacccaaagacacacgtgacccaccatcccgtctctgaccatgaggccaccctgaggtgctgg
gccctgggcttctaccctgcggagatcacactgacctggcagcgggatggcgaggaccaaactcaggacaccgagc
ttgtggagaccaggccagcaggagatggaaccttccagaagtgggcagctgtggtggtgccttctggagaagagca
gagatacacgtgccatgtgcagcacgaggggctgccagagcccctcaccctgagatgggagccatcttcccagccc
accatccccatcgtgggcatcgttgctggcctggctgtcctggctgtcctagctgtcctaggagctgtgAtggctg
ttgtgatgtgtaggaggaagagctcaggtggaaaaggagggagctgctctcaggctgcgtccagcaacagtgccca
gggctctgatgagtctctcatcgcttgtaa;

Cw*1205:

(SEQ ID NO: 1749)

atgcgggtcatggcgccccgaaccctcatcctgctgctctcgggagccctggccctgaccgagacctgggcctgct
cccactccatgaggtatttctacaccgccgtgtcccggcccggccgcggagagccccgcttcatcgcagtgggcta
cgtggacgacacgcagttcgtgcggttcgacagcgacgccgcgagtccaagaggggagccgcgggcgccgtgggtg
gagcaggaggggccggagtattgggaccgggagacacagaagtacaagcgccaggcacagactgaccgagtgaacc -continued tgcggaaActgcgcggctactacaaccagagcgaggccgggtctcacaccctccagtggatgtatggctgcgacct
ggggcccgacgggcgcctcctccgcgggtatgaccagtccgcctacgacggcaaggattacatcgccctgaacgag
gacctgcgctcctggacTgccgcggacacggcggctcagatcacccagcgcaagtgggaggcggcccgtgaggcgg
agcagtggagagcctacctggagggcacgtgcgtggagtggctccgcagatacctggagaacgggaaggagacgct
gcagcgcgcggaacacccaaagacacacgtgacccaccatcccgtctctgaccatgaggccaccctgaggtgctgg
gccctgggcttctaccctgcggagatcacactgacctggcagcgggatggcgaggaccaaactcaggacaccgagc
ttgtggagaccaggccagcaggagatggaaccttccagaagtgggcagctgtggtggtgccttctggagaagagca
gagatacacgtgccatgtgcagcacgaggggctgccagagccccteaccetgagatgggagccatcttcccagccc
accatcccatcgtgggcatcgttgctggcctggctgtcctggctgtcctagctgtcctaggagctgtgAtggctg
ttgtgatgtgtaggaggaagagctcaggtggaaaaggagggagctgctctcaggctgcgtccagcaacagtgccca
gggctctgatgagtctctcatcgcttgtaa;

Cw*1206: (SEQ ID NO: 1750)
gctcccactccatgaggtatttctacaccgccgtgtcccggcccggccgcggagagccccgcttcatcgcagtggg
ctacgtggacgacacgcagttcgtgcggttcgacagcgacgccgcgagtccaagaggggagccgcgggcgccgtgg
gtggagcaggaggggccggagtattgggaccgggagacacagaagtacaagcgccaggcacaggctgaccgagtga
gcctgcggaacctgcgcggctactacaaccagagcgaggccgggtctcacaccctccagtggatgtatggctgcga
cctggggcccgacgggcgcctcctccgcgggtatgaccagtccgcctacgacgTcaaggattacatcgccctgaac
gaggacctgcgctcctggactgccgcggacacggcggctcagatcacccagcgcaagtgggaggcggcccgtgagg
cggagcagtggagagcctacctggagggcacgtgcgtggagtggctccgcagatacctggagaacgggaaggagac
gctgcagcgcgcgcgg;

Cw*1207: (SEQ ID NO: 1751)
gctcccactccatgaggtatttctacaccgccgtgtcccggcccggccgcggagagccccgcttcatcgcagtggg
ctacgtggacgacacgcagttcgtgcggttcgacagcgacgccgcgagtccaagaggggagccgcgggcgccgtgg
gtggagcaggaggggccggagtattgggaccgggagacacagaagtacaagcgccaggcacaggctgaccgagtgG
gcctgcggaacctgcgcggctactacaaccagagcgaggccgggtctcacaccctccagtggatgtatggctgcga
cctggggcccgacgggcgcctcctccgcgggtatgaccagtccgcctacgacggcaaggattacatcgccctgaac
gaggacctgcgctcctggactgccgcggacacggcggctcagatcacccagcgcaagtgggaggcggcccgtgagg
cggagcagtggagagcctacctggagggcacgtgcgtggagtggctccgcagatacctggagaacgggaaggagac
gctgcagcgcgcgcgg;

Cw*1208: (SEQ ID NO: 1752)
atgcgggtcatggcgccccgaaccctcatcctgctgctctcgggagccctggccctgaccgagacctgggcctgct
cccactccatgaggtatttctacaccgccgtgtcccggcccggccgcggagagccccgcttcatcgcagtgggcta
cgtggacgacacgcagttcgtgcggttcgacagcgacgccgcgagtccaagaggggagccgcgggcgccgtgggtg
gagcaggaggggccggagtattgggaccgggagacacagaaCtacaagcgccaggcacaggctgaccgagtgagcc
tgcggaacctgcgcggctactacaaccagagcgaggccgggtctcacaccctccagaggatgtaCggctgcgacct
ggggcccgacgggcgcctcctccgcgggtatgaccagtccgcctacgacggcaaggattacatcgccctgaacgag
gacctgcgctcctggaccgcTgcggacacggcggctcagatcacccagcgcaagtgggaggcggcccgtgaggcgg
agcagtggagagcctacctggagggcacgtgcgtggagtggctccgcagatacctggagaacgggaaggagacgct
gcagcgcgcggaacacccaaagacacacgtgacccaccatcccgtctctgaccatgaggccaccctgaggtgctgg
gccctgggcttctaccctgcggagatcacactgacctggcagcgggatggcgaggaccaaactcaggacaccgagc
ttgtggagaccaggccagcaggagatggaaccttccagaagtgggcagctgtggtggtgccttctggagaagagca gagatacacgtgccatgtgcagcacgaggggctgccAgagcccctcaccctgagatgggagccatcttcccagccc accatcccatcgtgggcatcgttgctggcctggctgtcctggctgtcctagctgtcctaggagctgtgAtggctg ttgtgatgtgtaggaggaagagctcaggtggaaaaggagggagctgctctcaggctgcgtccagcaacagtgccca gggctctgatgagtctctcatcgcttgtaa;

Cw*140201:

(SEQ ID NO: 1753)

atgcgggtcatggcgccccgaaccctcatcctgctgctctcgggagccctggccctgaccgagacctgggcctgct cccactccatgaggtatttctCcacatccgtgtcccggcccggccgcggggagccccgcttcatcgcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggcccgggtctcacaccctccagtggatgtttggctgcgacct ggggcccgacgggcgcctcctccgcgggtatgaccagtCcgcctacgacggcaaggattacatcgccctgaacgag gatctgcgctcctggaccgccgcggacacggcggctcagatcacccagcgcaagtgggaggcggcccgtgaggcgg agcagcggagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaactcaggacaccgagc ttgtggagaccaggccagcaggagatggaaccttccagaagtgggcagctgtgGtggtgccttctggagaagagca gagatacacgtgccatgtgcagcacgaggggctgccggagcccctcaccctgagatgggagccgtcttcccagccc accatcccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*140202:

(SEQ ID NO: 1754)

gctcccactccatgaggtatttctCcacatccgtgtcccggcccggccgcggggagccccgcttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggcccgggtctcacaccctccagtggatgtTtggctgcga cctggggcccgacgggcgcctcctccgcgggtatgaccagtCcgcctacgacggcaaggattacatcgccctgaac gaggacctgcgctcctggaccgccgcggacacggcggctcagatcacccagcgcaagtgggaggcggcccgtgagg cggagcagcggagagcctacctggagggcacgtgcgtggagtggctccgcagatacctggagaacgggaaggagac gctgcagcgcgcgg;

Cw*1403:

(SEQ ID NO: 1755)

atgcgggtcatggcgccccgaaccctcatcctgctgctctcgggagccctggccctgaccgagacctgggcctgct cccactccatgaggtatttctCcacatccgtgtcccggcccggccgcggggagccccacttcatcgcagtgggcta cgtggacgacacgcagttcgtgcggttcgacagcgacgccgcgagtccAagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggcccgggtctcacaccctccagtggatgtttggctgcgacct ggggcccgacgggcgcctcctccgcgggtatgaccagtCcgcctacgacggcaaggattacatcgccctgaacgag gatctgcgctcctggaccgccgcggacacggcggctcagatcacccagcgcaagtgggaggcggcccgtgaggcgg agcagcggagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaactcaggacaccgagc -continued ttgtggagaccaggccagcaggagatggaaccttccagaagtgggcagctgtgGtggtgccttctggagaagagca gagatacacgtgccatgtgcagcacgaggggctgccggagcccctcaccctgagatgggagccgtcttcccagccc accatccccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

Cw*1404:

(SEQ ID NO: 1756)

gctcccactccatgaggtatttctCcacatccgtgtcccggcccggccgcggggagccccgcttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacaggctgaccgagtga AcctgcggaacctgcgcggctactacaaccagagcgaggccgggtctcacaccctccagtggatgtTtggctgcga cctggggcccgacgggcgcctcctccgcgggtatgaccagtCcgcctacgacggcaaggattacatcgccctgaac gaggaTctgcgctcctggaccgccgcggacacggcggctcagatcacccagcgcaagtgggaggcggcccgtgagg cggagcagcggagagcctacctggagggcacgtgcgtggagtggctccgcagatacctggagaacgggaaggagac gctgcagcgcgcgg;

Cw*1405:

(SEQ ID NO: 1757)

gctcccactccatgaggtatttctCcacatccgtgtcccggcccggccgcggggagccccgcttcatcgcagtggg ctacgtggacgacacgcagttcgtgcggttcgacagcgacgccgcgagtccgagaggggagccgcgggcgccgtgg gtggagcaggaggggccggagtattgggaccgggagacacagaagtacaagcgccaggcacagactgaccgagtga gcctgcggaacctgcgcggctactacaaccagagcgaggccgggtctcacaccctccagtggatgtAtggctgcga cctggggcccgacgggcgcctcctccgcgggtatgaccagtCcgcctacgacggcaaggattacatcgccctgaac gaggaTctgcgctcctggaccgccgcggacacggcggctcagatcacccagcgcaagtgggaggcggcccgtgagg cggagcagcggagagcctacctggagggcacgtgcgtggagtggctccgcagatacctggagaacgggaaggagac gctgcagcgcgcgg;

Cw*150201:

(SEQ ID NO: 1758)

atgcgggtcatggcgccccgaaccctcctcctgctgctctcgggagccctggccctgaccgagacctgggcctgct cccactccatgaggtatttctacaccgctgtgtcccggcccggccgcggagagccccacttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaactacaagcgccaggcacagactgaccgagtgaacc tgcggaaactgcgcggctactacaaccagagcgaggccgggtctcacatcatccagaggatgtatggctgcgacct ggggcccgacgggcgcctcctccgcgggcatgaccagttAgcctacgacggcaaggattacatcgccctgaacgag gacctgcgctcctggaccgccgcggacacggcggctcagatcacccagcgcaagtgggaggcggcccgtgaggcgg agcagctgagagcctacctggagggcacgtgcgtggagtggctccgcagatacctggagaacgggaaggagacgct gcagcgcgcggaacacccaaagacacacgtgacccaccatcccgtctctgaccatgaggccaccctgagggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccatcttcccagccc accatccccatcgtgggcatcgttgctggcctggctgtcctggctgtcctagctgtcctaggagctgtgAtggctg ttgtgatgtgtaggaggaagagctcaggtggaaaaggagggagctgctctcaggctgcgtccagcaacagtgccca gggctctgatgagtctctcatcgcttgtaa;

Cw*150202:
(SEQ ID NO: 1759)
gctcccattccatgaggtatttctacaccgctgtgtcccggcccggccgcggagagccccActtcatcgcagtggg ctacgtggacgacacgcagttcgtgcggttcgacagcgacgccgcgagtccaagaggggagccgcgggcgccgtgg gtggagcaggaggggccggagtattgggaccgggagacacagaaCtacaagcgccaggcacagactgaccgagtga acctgcggaaActgcgcggctactacaaccagagcgaggccgggtctcacatcatccagaggatgtatggctgcga cctggggcccgacgggcgcctcctccgcgggCatgaccagttAgcctacgacggcaaggattacatcgccctgaac gaggacctgcgctcctggaccgccgcggacacggcggctcagatcacccagcgcaagtgggaggcggcccgtgagg cggagcagcTgagagcctacctggagggcacgtgcgtggagtggctccgcagatacctggagaacgggaaggagac gctgcagcgcgcgcgg;

Cw*1503:
(SEQ ID NO: 1760)
atgcgggtcatggcgccccgaaccctcctcctgctgctctcgggagccctggccctgaccgagacctgggcctgct cccactccatgaggtatttctacaccgctgtgtcccggcccggccgcggagagccccacttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaactacaagcgccaggcacagaGctgaccgagtgaacc tgcggaaactgcgcggctactacaaccagagcgaggccgggtctcacatcatccagaggatgtatggctgcgacct ggggcccgacgggcgcctcctccgcgggcatgaccagttAgcctacgacggcaaggattacatcgccctgaacgag gacctgcgctcctggaccgccgcggacacggcggctcagatcacccagcgcaagtgggaggcggcccgtgaggcgg agcagctgagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccatcttcccagccc accatccccatcgtgggcatcgttgctggcctggctgtcctggctgtcctagctgtcctaggagctgtgAtggctg ttgtgatgtgtaggaggaagagctcaggtggaaaaggagggagctgctctcaggctgcgtccagcaacagtgccca gggctctgatgagtctctcatcgcttgtaa;

Cw*1504:
(SEQ ID NO: 1761)
atgcgggtcatggcgccccgaaccctcctcctgctgctctcgggagccctggccctgaccgagacctgggcctgct cccactccatgaggtatttctacaccgctgtgtcccggcccggccgcggagagccccacttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaactacaagcgccaggcacagactgaccgagtgaacc tgcggaaactgcgcggctactacaaccagagcgaggccgggtctcacatcatccagaggatgtatggctgcgacct ggggcccgacgggcgcctcctccgcgggtatgaccagtCcgcctacgacggcaaggattacatcgccctgaacgag gacctgcgctcctggaccgccgcggacacggcggctcagatcacccagcgcaagtgggaggcggcccgtgaggcgg agcagcTgagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccatcttcccagccc accatccccatcgtgggcatcgttgctggcctggctgtcctggctgtcctagctgtcctaggagctgtgAtggctg -continued ttgtgatgtgtaggaggaagagctcaggtggaaaaggagggagctgctctcaggctgcgtccagcaacagtgccca gggctctgatgagtctctcatcgcttgtaa;

Cw*150501:

(SEQ ID NO: 1762)

atgcgggtcatggcgccccgaacTctcctcctgctgctctcggggagccctggccctgaccgagacctgggcctgct cccactccatgaggtatttctacaccgctgtgtcccggcccggccgcggagagccccacttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaactacaagcgccaggcacagactgaccgagtgaacc tgcggaaactgcgcggctactacaaccagagcgaggcccgggtctcacatcatccagaggatgtatggctgcgacct ggggcccgacgggcgcctcctccgcgggcatgaccagttcgcctacgacggcaaggattacatcgccctgaacgag gacctgcgctcctggaccgccgcggacacggcggctcagatcacccagcgcaagtgggaggcggcccgtgaggcgg agcagctgagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagccctcaccctgagatgggagccatcttcccagccc accatccccatcgtgggcatcgttgctggcctggctgtcctggctgtcctagctgtcctaggagctgtgatggctg ttgtgatgtgtaggaggaagagctcaggtggaaaaggagggagctgctctcaggctgcgtccagcaacagtgccca gggctctgatgagtctctcatcgcttgtaa;

Cw*150502:

(SEQ ID NO: 1763)

atgcgggtcatggcgccccgaaccctcctcctgctgctctcggggagccctggccctgaccgagacctgggcctgct cccactccatgaggtatttctacaccgctgtgtcccggcccggccgcggagagccccacttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaactacaagcgccaggcacagactgaccgagtgaacc tgcggaaactgcgcggctactacaaccagagcgaggcccgggtctcacatcatccagaggatgtatggctgcgacct ggggcccgacgggcgcctcctccgcgggCatgaccagtTcgcctacgacggcaaggattacatcgccctgaacgag gacctgcgctcctggaccgccgcggacacggcggctcagatcacccagcgcaagtgggaggcggcccgtgaggcgg agcagctgagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagccctcaccctgagatgggagccatcttcccagccc accatccccatcgtgggcatcgttgctggcctggctgtcctggctgtcctagctgtcctaggagctgtgAtggctg ttgtgatgtgtaggaggaagagctcaggtggaaaaggagggagctgctctcaggctgcgtccagcaacagtgccca gggctctgatgagtctctcatcgcttgtaa;

Cw*1506:

(SEQ ID NO: 1764)

atgcgggtcatggcgccccgaaccctcctcctgctgctctcggggagccctggccctgaccgagacctgggcctgct cccactccatgaggtatttctacaccgctgtgtcccggcccggccgcggagagccccacttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaactacaagcgccaggcacagactgaccgagtgaacc tgcggaaactgcgcggctactacaaccagagcgaggcccgggtctcacatcatccagaggatgtatggctgcgacct -continued ggggcccgacgggcgcctcctccgcgggCatgaccagtacgcctacgacggcaaggattacatcgccctgaacgag gacctgcgctcctggaccgccgcggacacggcggctcagatcacccagcgcaagtgggaggcggcccgtgaggcgg agcagctgagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccatcttcccagccc accatccccatcgtgggcatcgttgctggcctggctgtcctggctgtcctagctgtcctaggagctgtgAtggctg ttgtgatgtgtaggaggaagagctcag;

Cw*1507:
(SEQ ID NO: 1765)
gctcccactccatgaggtatttctacaccgctgtgtcccggcccggccgcggagagccccActtcatcgcagtggg ctacgtggacgacacgcagttcgtgcggttcgacagcgacgccgcgagtccaagaggggagccgcgggcgccgtgg gtggagcaggaggggccggagtattgggaccgggagacacagaaCtacaagcgccaggcacagactgaccgagtga gcctgcggaacctgcgcggctactacaaccagagcgaggcccgggtctcacatcatccagaggatgtatggctgcga cctggggcccgacgggcgcctcctccgcgggCatgaccagttAgcctacgacggcaaggattacatcgccctgaac gaggacctgcgctcctggaccgccgcggacacggcggctcagatcacccagcgcaagtgggaggcggcccgtgagg cggagcagcTgagagcctacctggagggcacgtgcgtggagtggctccgcagatacctggagaacgggaaggagac gctgcagcgcgcgcgg;

Cw*1508:
(SEQ ID NO: 1766)
gctcccactccatgaggtatttctacaccgctgtgtcccggcccggccgcggagagccccActtcatcgcagtggg ctacgtggacgacacgcagttcgtgcggttcgacagcgacgccgcgagtccaagaggggagccgcgggcgccgtgg gtggagcaggaggggccggagtattgggaccgggagacacagaaCtacaagcgccaggcacagactgaccgagtga acctgcggaaActgcgcggctactacaaccagagcgaggcccgggtctcacatcAtccagaggatgtatggctgcga cctggggcccgacgggcgcctcctccgcgggCatgaccagttAgcctacgacggcaaggattacatcgccctgaac gaggacctgcgctcctggaccgccgcggacacggcggctcagatcacccagcgcaagtgggaggcggcccgtgagg cggagcagcggagagcctacctggagggcacgtgcgtggagtggctccgcagatacctggagaacgggaaggagac gctgcagcgcgcgcgg;

Cw*1509:
(SEQ ID NO: 1767)
gctcccactccatgaggtatttctacaccgctgtgtcccggcccggccgcggagagccccacttcatcgcagtggg ctacgtggacgacacgcagttcgtgcggttcgacagcgacgccgcgagtccaagaggggagccgcgggcgccgtgg gtggagcaggaggggccggagtattgggaccgggagacacagaactacaagcgccaggcacagactgaccgagtga acctgcggaaactgcgcggctactacaaccagagcgaggcccgggtctcacatcatccagaggatgtatggctgcga cctggggcccgacgggcgcctcctccgcgggCatgaccagtCcgcctacgacggcaaggattacatcgccctgaac gaggacctgcgctcctggaccgccgcggacacggcggctcagatcacccagcgcaagtgggaggcggcccgtgagg cggagcagcTgagagcctacctggagggcacgtgcgtggagtggctccgcagatacctggagaacgggaaggagac gctgcagcgcgcgcgg;

Cw*1510:
(SEQ ID NO: 1768)
gctcccactccatgaggtatttctacaccgccgtgtcccggcccggccgcggagagccccgcttcatcgcagtggg ctacgtggacgacacgcagttcgtgcggttcgacagcgacgccgcgagtccaagaggggagccgcgggcgccgtgg gtggagcaggaggggccggagtattgggaccgggagacacagaaCtacaagcgccaggcacagactgaccgagtga acctgcggaaActgcgcggctactacaaccagagcgaggcccgggtctcacatcatccagaggatgtatggctgcga cctgggcccgacgggcgcctcctccgcgggCatgaccagttAgcctacgacggcaaggattacatcgccctgaac gaggacctgcgctcctggaccgccgcggacacggcggctcagatcacccagcgcaagtgggaggcggcccgtgagg cggagcagcTgagagcctacctggagggcacgtgcgtggagtggctccgcagatacctggagaacgggaaggagac gctgcagcgcgcgg;

Cw*1511:
(SEQ ID NO: 1769)
gctcccactccatgaggtatttctacaccgctgtgtcccggcccAgccgcggagagccccActtcatcgcagtgggg ctacgtggacgacacgcagttcgtgcggttcgacagcgacgccgcgagtccaagaggggagccgcgggcgccgtgg gtggagcaggaggggccggagtattgggaccgggagacacagaagtacaagcgccaggcacagactgaccgagtga acctgcggaaActgcgcggctactacaaccagagcgaggccgggtctcacatcatccagaggatgtatggctgcga cctggggcccgacgggcgcctcctccgcgggCatgaccagttAgcctacgacggcaaggattacatcgccctgaac gaggacctgcgctcctggaccgccgcggacacggcggctcagatcacccagcgcaagtgggaggcggcccgtgagg cggagcagcTgagagcctacctggagggcacgtgcgtggagtggctccgcagatacctggagaacgggaaggagac gctgcagcgcgcgg;

Cw*1601:
(SEQ ID NO: 1770)
atgcgggtcatggcgccccgaaccctcatcctgctgctctcggggagccctggccctgaccgagacctgggcctgct cccactccatgaggtatttctacaccgccgtgtcccggcccggccgcggagagccccgcttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggccgggtctcacaccctccagtggatgtatggctgcgacct ggggcccgacgggcgcctcctccgcgggtatgaccagtccgcctacgacggcaaggattacatcgccctgaacgag gacctgcgctcctggaccgccgcggacacggcggctcagatcacccagcgcaagtgggaggcggcccgtgcggcgg agcagcAgagagcctacctggagggcacgtgcgtggagtggctccgcagatacctggagaacgggaaggagacgct gcagcgcgcggaacacccaaagacacacgtgacccaccatctcgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccatcttcccagccc accatccccatcgtgggcatcgttgctggcctggctgtcctggctgtcctagctgtcctaggagctgtggtggctg ttgtTatgtgtaggaggaagagctcaggtggaaaaggagggagctgctctcaggctgcgtccagcaacagtgccca gggctctgatgagtctctcatcgcttgtaa;

Cw*1602:
(SEQ ID NO: 1771)
atgcgggtcatggcgccccgaaccctcatcctgctgctctcggggagccctggccctgaccgagacctgggcctgct cccactccatgaggtatttctacaccgccgtgtcccggcccggccgcggagagccccgcttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaagtacaagcgccaggcacagactgaccgagtgaacc tgcggaaActgcgcggctactacaaccagagcgaggccgggtctcacaccctccagtggatgtatggctgcgacct ggggcccgacgggcgcctcctccgcgggtatgaccagtccgcctacgacggcaaggattacatcgccctgaacgag gacctgcgctcctggaccgccgcggacacggcggctcagatcacccagcgcaagtgggaggcggcccgtgcggcgg agcagcAgagagcctacctggagggcacgtgcgtggagtggctccgcagatacctggagaacgggaaggagacgct gcagcgcgcggaacacccaaagacacacgtgacccaccatctcgtctctgaccatgaggccaccctgaggtgctgg gccctgggcttctaccctgcggagatcacactgacctggcagcgggatggcgaggaccaaactcaggacaccgagc -continued ttgtggagaccaggccagcaggagatggaaccttccagaagtgggcagctgtggtggtgccttctggagaagagca gagatacacgtgccatgtgcagcacgaggggctgccggagcccctcaccctgagatgggagccatcttcccagccc accatccccatcgtgggcatcgttgctggcctggctgtcctggctgtcctagctgtcctaggagctgtggtggctg ttgtTatgtgtaggaggaagagctcaggtggaaaaggagggagctgctctcaggctgcgtccagcaacagtgccca gggctctgatgagtctctcatcgcttgtaa;

Cw*160401:

(SEQ ID NO: 1772)
atgcgggtcatggcgccccgaaccctcatcctgctgctctcgggagccctggccctgaccgagacctgggcctgct cccactccatgaggtatttctacaccgccgtgtcccggcccggccgcggagagccccgcttcatcgcagtgggcta cgtggacgacacgcagttcgtgcggttcgacagcgacgccgcgagtccaagaggggagccgcgggcgccgtgggtg gagcaggaggggccggagtattgggaccgggagacacagaagtacaagcgccaggcacagactgaccgagtgagcc tgcggaacctgcgcggctactacaaccagagcgaggccgggtctcacaccctccagtggatgtatggctgcgacct ggggcccgacgggcgcctcctccgcgggtatgaccagtccgcctacgacggcaaggattacatcgccctgaacgag gacctgcgctcctggaccgccgcggacacggcggctcagatcacccagcgcaagtgggaggcggcccgtgcggcgg agcagTggagagcctacctggagggcacgtgcgtggagtggctccgcagatacctggagaacgggaaggagacgct gcagcgcgcggaacacccaaagacacacgtgacccaccatctcgtctctgaccatgaggccaccctgaggtgctgg gccctgggcttctaccctgcggagatcacactgacctggcagcgggatggcgaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagcccctcaccctgagatgggagccatcttcccagccc accatccccatcgtgggcatcgttgctggcctggctgtcctggctgtcctagctgtcctaggagctgtggtggctg ttgtTatgtgtaggaggaagagctcag;

Cw*1701:

(SEQ ID NO: 1773)
atgcgggtcatggcgccccaagccctcctcctgctgctctcgggagccctggccctgatcgagacctgggccggct cccactccatgaggtatttctacaccgccgtgtcccggcccggccgcggagagccccgcttcatcgcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacaggctgaccgagtgaacc tgcggaaactgcgcggctactacaaccagagcgaggccggttctcacaccatccagaggatgtatggctgcgacct ggggcccgacgggcgcctcctccgcgggtataaccagttcgcctacgacggcaaggattacatcgccctgaacgag gacctgcgctcctggaccgcggcggacacggcggctcagatctcccagcgcaagttggaggcggcccgtgaggcgg agcagctgagagcctacctggagggcgagtgcgtggagtggctccgcggatacctggagaacgggaaggagacgct gcagcgcgcggaacgcccaaagacacacgtgacccaccatcccgtctctgaccatgaggccaccctgaggtgctgg gccctgggcttctaccctgcggagatcacactgacctggcagcgggatggggaggaccaaactcaggacaccgagc ttgtggagaccaggccagcaggagatggaaccttccagaagtgggcagctgtggtggtgccttctggacaagaaca gagatacacgtgccatgtgcagcacgaggggctgcaggagcccctgcaccctgagatggaagccgtcttcccagccc accatcccaacttgggcatcgtttctggcccagctgtcctggctgtcctggctgtcctggctgtcctagctgtcc taggagctgtggtcgctgctgtgataC;

Cw*1702:

(SEQ ID NO: 1774)
atgcgggtcatggcgccccgaaccctcatcctgctgctctcgggagccctggccctgatcgagacctgggccggct cccactccatgaggtatttctacaccgccgtgtcccggcccggccgcggagagccccgcttcatcgcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacaggctgaccgagtgaacc tgcggaaactgcgcggctactacaaccagagcgaggccggttctcacaccatccagaggatgtatggctgcgacct ggggcccgacgggcgcctcctccgcgggtataaccagttcgcctacgacggcaaggattacatcgccctgaacgag gacctgcgctcctggaccgcggcggacacggcggctcagatctcccagcgcaagttggaggcggcccgtgaggcgg agcagctgagagcctacctggagggcgagtgcgtggagtggctccgcggatacctggagaacgggaaggagacgct gcagcgcgcggaacgcccaaagacacacgtgacccaccatcccgtctctgaccatgaggccaccctgaggtgctgg gccctgggcttctaccctgcggagatcacactgacctggcagcgggatggggaggaccaaaactcaggacaccgagc ttgtggagaccaggccagcaggagatggaaccttccagaagtgggcagctgtggtggtgccttctggacaagaaca gagatacacgtgccatgtgcagcacgaggggctgcaggagccctGcaccctgagatgga;

Cw*1703:
(SEQ ID NO: 1775)
atgcgggtcatggcgccccaagccctcctcctgctgctctcgggagccctggccctgatcgagacctggAccggct cccactccatgaggtatttctacaccgccgtgtcccggcccggccgcggagagccccgcttcatcgcagtgggcta cgtggacgacacgcagttcgtgcggttcgacagcgacgccgcgagtccgagaggggagccgcgggcgccgtgggtg gagcaggaggggccggagtattgggaccgggagacacagaagtacaagcgccaggcacaggctgaccgagtgaacc tgcggaaactgcgcggctactacaaccagagcgaggccggttctcacaccatccagaggatgtatggctgcgacct ggggcccgacgggcgcctcctccgcgggtataaccagttcgcctacgacggcaaggattacatcgccctgaacgag gacctgcgctcctggaccgcggcggacacggcggctcagatctcccagcgcaagttggaggcggcccgtgaggcgg agcagctgagagcctacctggagggcgagtgcgtggagtggctccgcggatacctggagaacgggaaggagacgct gcagcgcgcggaacgcccaaagacacacgtgacccaccatcccgtctctgaccatgaggccaccctgaggtgctgg gccctgggcttctaccctgcggagatcacactgacctggcagcgggatggggaggaccaaaactcaggacaccgagc ttgtggagaccaggccagcaggagatggaaccttccagaagtgggcagctgtggtggtgccttctggacaagaaca gagatacacgtgccatgtgcagcacgaggggctgcaggagccctgcaccctgagatggaagccgtcttcccagccc accatccccaacttgggcatcgtttctggcccagctgtcctggctgtcctggctgtcctggctgtcctagctgtcc taggagctgtggtcgctgctgtgatac;

Cw*1801:
(SEQ ID NO: 1776)
atgcgggtcatggcgccccgagccctcctcctgctgctctcgggaggcctggccctgaccgagacctgggcctgct cccactccatgaggtatttcgacaccgccgtgtcccggcccggccgcggagagccccgcttcatctcagtgggcta cgtggacgacacgcagttcgtgcggttcgacagcgacgccgcgagtccgagaggggagccccgggcgccgtgggtg gagcaggaggggccggagtattgggaccgggagacacagaagtacaagcgccaggcacaggctgaccgagtgaacc tgcggaaactgcgcggctactacaaccagagcgaggacgggtctcacacccaccagaggatgtttggctgcgacct ggggcccgacgggcgcctcctccgcgggtataaccagttcgcctacgacggcaaggattacatcgccctgaacgag gatctgcgctcctggaccgccgcggacacggcggctcagatcacccagcgcaagtgggaggcggcccgtgaggcgg agcagctggagagcctacctggagggcacgtgcgtggagtggctccgcagatacctggagaacgggaaggagacgct gcagcgcgcggaacacccaaagacacacgtgacccaccatcccgtctctgaccatgaggccaccctgaggtgctgg gccctgggcttctaccctgcggagatcacactgacctggcagtgggatggggaggaccaaaactcaggacaccgagc ttgtggagaccaggccagcaggagatggaaccttccagaagtgggcagctgtggtggtgccttctggagaagagca gagatacacgtgccatgtgcagcacgaggggctgccggagcccctcaccctgagatggAagccgtcttcccagccc accatccccatcgtgggcatcgttgctggcctggctgtcctggTtgtcctagctgtcctaggagctgtggtggctg ttgtgatgtgtaggaggaagagctcaggtggaaaaggaggggagctgctctcaggctgcgtccagcaacagtgccca gggctctgatgagtctctcatcgcttgtaa;

Cw*1802:

(SEQ ID NO: 1777)

atgcgggtcatggcgcccgagccctcctcctgctgctctcggggaggcctggccctgaccgagacctgggcctgct cccactccatgaggtatttcgacaccgccgtgtcccggcccggccgcggagagccccgcttcatctcagtgggcta cgtggacgacacgcagttcgtgcggttcgacagcgacgccgcgagtccgagaggggagccCcgggcgccgtgggtg gagcaggaggggccggagtattgggaccgggagacacagaagtacaagcgccaggcacaggctgaccgagtgaacc tgcggaaactgcgcggctactacaaccagagcgaggacgggtctcacaccctccagaggatgtttggctgcgacct ggggccggacgggcgcctcctccgcgggtataaccagttcgcctacgacggcaaggattacatcgccctgaacgag gaTctgcgctcctggaccgccgcggacacggcggctcagatcacccagcgcaagtgggaggcggcccgtgaggcgg agcagcggagagcctacctggagggcacgtgcgtggagtggctccgcagatacctggagaacgggaaggagacgct gcagcgcgggaacacccaaagacacacgtgacccaccatcccgtctctgaccatgaggccaccctgaggtgctgg gccctgggcttctaccctgcggagatcacactgacctggcagtgggatggggaggaccaaactcaggacaccgagc ttgtggagaccaggccagcaggagatggaaccttccagaagtgggcagctgtggtggtgccttctggagaagagca gagatacacgtgccatgtgcagcacgaggggctgccggagcccctcaccctgagatggAagccgtcttcccagccc accatcccatcgtgggcatcgttgctggcctggctgtcctggctgtcctagctgtcctaggagctgtggtggctg ttgtgatgtgtaggaggaagagctcaggtggaaaaggagggagctgctctcaggctgcgtccagcaacagtgccca gggctctgatgagtctctcatcgcttgtaa;

In the following, Probe Lists C1 and C2 are shown In Tables 9-1 to 9-4 and Tables 10-1 to 10-4 respectively.

TABLE 9-1

| Probe No. | Base Sequence | |
|---|---|---|
| 0 | c acc ctc cag tgg atg tG | (SEQ ID No: 1778) |
| 1 | c cgc ggg tat gac cag tA | (SEQ ID No: 1779) |
| 2 | g acc gcc gcg gac acC | (SEQ ID No: 1780) |
| 3 | ag aag tgg gca gct gtg A | (SEQ ID No: 1781) |
| 4 | c ctc ctc cgc ggg tat A | (SEQ ID No: 1782) |
| 5 | g cgc tcc tgg acc gcT | (SEQ ID No: 1783) |
| 6 | g cac gag ggg ctg ccA | (SEQ ID No: 1784) |
| 7 | ct gtc cta gga gct gtg A | (SEQ ID No: 1785) |
| 8 | c acc ctc cag agg atg tC | (SEQ ID No: 1786) |
| 9 | gg gag gcg gcc cgt gT | (SEQ ID No: 1787) |
| 10 | ggg cgc ctc ctc cgc A | (SEQ ID No: 1788) |
| 11 | c aag tgg gag gcg gcc T | (SEQ ID No: 1789) |
| 12 | c cgt gag gcg gag cag T | (SEQ ID No: 1790) |
| 13 | a gtg aac ctg cgg aaa ctA | (SEQ ID No: 1791) |
| 14 | cc ctg ggc ttc tac cct A | (SEQ ID No: 1792) |
| 15 | g acc gcc gcg gac acA | (SEQ ID No: 1793) |
| 16 | gct gtg tcc cgg ccc A | (SEQ ID No: 1794) |
| 17 | g acc gcc gcg gac acG | (SEQ ID No: 1795) |
| 18 | cc ctg aga tgg gag ccA | (SEQ ID No: 1796) |

TABLE 9-1-continued

| Probe No. | Base Sequence | |
|---|---|---|
| 19 | gg tct cac acc ctc cag A | (SEQ ID No: 1797) |
| 20 | cgc ggg tat gac cag tC | (SEQ ID No: 1798) |
| 21 | gcc tac ctg gag ggc gA | (SEQ ID No: 1799) |
| 22 | c tcc cac tcc atg agg tG | (SEQ ID No: 1800) |
| 23 | cgc ggg cat gac cag ttA | (SEQ ID No: 1801) |
| 24 | g gac caa act cag gac acT | (SEQ ID No: 1802) |
| 25 | c aac cag agc gag gcc A | (SEQ ID No: 1803) |
| 26 | ag gcc agg tct cac atc A | (SEQ ID No: 1804) |
| 27 | g aag tgg gca gct gtg G | (SEQ ID No: 1805) |
| 28 | gcg gac acg gcg gcC | (SEQ ID No: 1806) |
| 29 | at ggc tgc gac gtg ggA | (SEQ ID No: 1807) |
| 30 | g gcc ggg tct cac atc A | (SEQ ID No: 1808) |

TABLE 9-2

| Probe No. | Base Sequence | |
|---|---|---|
| 31 | c atc atc cag agg atg taC | (SEQ ID No: 1809) |
| 32 | c cgc aga tac ctg aag aaT | (SEQ ID No: 1810) |
| 33 | ct cac acc ctc cag agC | (SEQ ID No: 1811) |
| 34 | ctc ctc cgc ggg tat gT | (SEQ ID No: 1812) |
| 35 | ca cag act gac cga gtg aA | (SEQ ID No: 1813) |

TABLE 9-2-continued

| Probe No. | Base Sequence | |
|---|---|---|
| 36 | cga gtg aac ctg cgg aaA | (SEQ ID No: 1814) |
| 37 | gg atg tat ggc tgc gac G | (SEQ ID No: 1815) |
| 38 | gcc tac ctg gag ggc cT | (SEQ ID No: 1816) |
| 39 | gac cgg gag aca cag aaC | (SEQ ID No: 1817) |
| 40 | g gag ccc cac ttc atc G | (SEQ ID No: 1818) |
| 41 | cga gtg agc ctg cgg aaA | (SEQ ID No: 1819) |
| 42 | cgc ggg tat gac tag ttA | (SEQ ID No: 1820) |
| 43 | g gag gcg gcc cgt gC | (SEQ ID No: 1821) |
| 44 | c tac aac cag agc gag gA | (SEQ ID No: 1822) |
| 45 | cgt gag gcg gag cag cT | (SEQ ID No: 1823) |
| 46 | cta gct gtc cta gga gct A | (SEQ ID No: 1824) |
| 47 | ggc tac gtg gac gac acA | (SEQ ID No: 1825) |
| 48 | gc cgc gga gag ccc cA | (SEQ ID No: 1826) |
| 49 | g aga tac acg tgc cat gtT | (SEQ ID No: 1827) |
| 50 | ga ggg gag ccg cgg gA | (SEQ ID No: 1828) |
| 51 | c atc gca gtg ggc tac C | (SEQ ID No: 1829) |
| 52 | c tgc gac ctg ggg ccG | (SEQ ID No: 1830) |
| 53 | tc tcc aca tcc gtg tcc T | (SEQ ID No: 1831) |
| 54 | c aag cgc cag gca cag G | (SEQ ID No: 1832) |
| 55 | gg acc gcc gcg gac aA | (SEQ ID No: 1833) |
| 56 | ctc act ctg aga tgg gG | (SEQ ID No: 1834) |
| 57 | tg tgc gtg gag tgg ctG | (SEQ ID No: 1835) |
| 58 | cc atc tct gac cat gag gT | (SEQ ID No: 1836) |
| 59 | ac ctg gag aac ggg aag A | (SEQ ID No: 1837) |
| 60 | c cgc ggg tat aac cag tT | (SEQ ID No: 1838) |

TABLE 9-3

| Probe No. | Base Sequence | |
|---|---|---|
| 61 | g gag ccg cgg gcg cG | (SEQ ID No: 1839) |
| 62 | t ccg aga ggg gag ccC | (SEQ ID No: 1840) |
| 63 | g agg tat ttc tac acc gcT | (SEQ ID No: 1841) |
| 64 | c gac gcc gcg agt ccA | (SEQ ID No: 1842) |
| 65 | gt cca aga ggg gag ccC | (SEQ ID No: 1843) |
| 66 | gcg ccg tgg gtg gag A | (SEQ ID No: 1844) |
| 67 | c acc ctc cag agg atg tA | (SEQ ID No: 1845) |
| 68 | g atc acc cag cgc aag tT | (SEQ ID No: 1846) |
| 69 | g acg ctg cag cgc gcA | (SEQ ID No: 1847) |
| 70 | c tct gat gag tct ctc atc A | (SEQ ID No: 1848) |
| 71 | gag cca tct tcc cag ccT | (SEQ ID No: 1849) |
| 72 | ga gcc tac ctg gag ggA | (SEQ ID No: 1850) |
| 73 | t gcg gcg gag cag gaC | (SEQ ID No: 1851) |
| 74 | aac ctg cgc ggc tac taT | (SEQ ID No: 1852) |
| 75 | g tct cac acc ctc cag aaT | (SEQ ID No: 1853) |
| 76 | a gct gtg gtc acc gct aA | (SEQ ID No: 1854) |
| 77 | c acc ctc cag agg atg tT | (SEQ ID No: 1855) |
| 78 | ag gac ggg tct cac atc A | (SEQ ID No: 1856) |
| 79 | ac atc atc cag agg atg tC | (SEQ ID No: 1857) |
| 80 | tgc tct cag gct gcg tG | (SEQ ID No: 1858) |
| 81 | c cgc ggg tat gac cag tT | (SEQ ID No: 1859) |
| 82 | g gag acg ctg cag cgc A | (SEQ ID No: 1860) |
| 83 | g ccc ctc acc atg agC | (SEQ ID No: 1861) |

TABLE 9-3-continued

| Probe No. | Base Sequence | |
|---|---|---|
| 84 | ggg agc tgc tct cag gT | (SEQ ID No: 1862) |
| 85 | cgt acg gcg gag cag cT | (SEQ ID No: 1863) |
| 86 | acc ctc cag agg atg taC | (SEQ ID No: 1864) |
| 87 | tgg gag gcg gcc cgt A | (SEQ ID No: 1865) |
| 88 | cgc aga tac ctg gag aac A | (SEQ ID No: 1866) |
| 89 | gcc tac ctg gag ggc G | (SEQ ID No: 1867) |
| 90 | ga tac ctg gag aac ggg G | (SEQ ID No: 1868) |

TABLE 9-4

| Probe No. | Base Sequence | |
|---|---|---|
| 91 | ac ctg cgc tcc tgg acT | (SEQ ID No: 1869) |
| 92 | g cgc tcc tgg acc gcG | (SEQ ID No: 1870) |
| 93 | a gag ccc cgc ttc atc G | (SEQ ID No: 1871) |
| 94 | c acc ctc cag tgg atg tA | (SEQ ID No: 1872) |
| 95 | cag tcc gcc tac gac gT | (SEQ ID No: 1873) |
| 96 | a cag gct gac cga gtg G | (SEQ ID No: 1874) |
| 97 | cac tcc atg agg tat ttc tC | (SEQ ID No: 1875) |
| 98 | c acc ctc cag tgg atg tT | (SEQ ID No: 1876) |
| 99 | a cag gct gac cga gtg aA | (SEQ ID No: 1877) |
| 100 | atc gcc ctg aac gag gaT | (SEQ ID No: 1878) |
| 101 | gc ctc ctc cgc ggg C | (SEQ ID No: 1879) |
| 102 | tc atg gcg ccc cga acT | (SEQ ID No: 1880) |
| 103 | cgc ggg cat gac cag tT | (SEQ ID No: 1881) |
| 104 | cgc ggg cat gac cag tC | (SEQ ID No: 1882) |
| 105 | gt gcg gcg gag cag cA | (SEQ ID No: 1883) |
| 106 | gct gtg gtg gct gtt gtT | (SEQ ID No: 1884) |
| 107 | cgt gcg gcg gag cag T | (SEQ ID No: 1885) |
| 108 | tg gtc gct gct gtg ata C | (SEQ ID No: 1886) |
| 109 | gg ctg cag gag ccc tG | (SEQ ID No: 1887) |
| 110 | cc ctg atc gag acc tca A | (SEQ ID No: 1888) |
| 111 | cc ctc acc ctg aga tgg A | (SEQ ID No: 1889) |
| 112 | Ggc ctg gct gtc ctg gT | (SEQ ID No: 1890) |

TABLE 10-1

| Probe No. | Base Sequence | |
|---|---|---|
| 0 | g tgg atg tGt ggc tgc g | (SEQ ID No: 1891) |
| 1 | at gac cag tAc gcc tac g | (SEQ ID No: 1892) |

TABLE 10-1-continued

| Probe No. | Base Sequence | |
|---|---|---|
| 2 | gcg gac acC gcg gct c | (SEQ ID No: 1893) |
| 3 | gca gct gtg Atg gtg cct | (SEQ ID No: 1894) |
| 4 | cgc ggg tat Aac cag ttc | (SEQ ID No: 1895) |
| 5 | tgg acc gcT gcg gac ac | (SEQ ID No: 1896) |
| 6 | ggg ctg ccA gag ccc c | (SEQ ID No: 1897) |
| 7 | gga gct gtg Atg gct gtt | (SEQ ID No: 1898) |
| 8 | g agg atg tCt ggc tgc g | (SEQ ID No: 1899) |
| 9 | g gcc cgt gTg gcg gag | (SEQ ID No: 1900) |
| 10 | ctc ctc cgc Agg tat gac | (SEQ ID No: 1901) |
| 11 | g gcg gcc Tgt gag gcg | (SEQ ID No: 1902) |
| 12 | cg gcg cag Tgg aga gcc | (SEQ ID No: 1903) |
| 13 | g cgg aaa ctA cgc ggc ta | (SEQ ID No: 1904) |
| 14 | ttc tat cct Acg gag atc a | (SEQ ID No: 1905) |
| 15 | gcg gac acA gcg gct c | (SEQ ID No: 1906) |
| 16 | c cgg ccc Agc cgc gg | (SEQ ID No: 1907) |
| 17 | gcg gac acG gcg gct c | (SEQ ID No: 1908) |
| 18 | a tgg gag ccA tct tcc ca | (SEQ ID No: 1909) |
| 19 | acc ctc cag Agg atg tat g | (SEQ ID No: 1910) |
| 20 | t gac cag tCc gcc tat g | (SEQ ID No: 1911) |
| 21 | g gag ggc gAg tgc gtg | (SEQ ID No: 1912) |
| 22 | cc atg agg tGt ttc tac ac | (SEQ ID No: 1913) |
| 23 | t gac cag ttA gcc tac gac | (SEQ ID No: 1914) |
| 24 | t tag gac acT gag ctt gtg | (SEQ ID No: 1915) |
| 25 | gc gag gcc Agg tct cac | (SEQ ID No: 1916) |
| 26 | tct cac atc Atc cag agg a | (SEQ ID No: 1917) |
| 27 | ca gct gtg Gtg gtg cct | (SEQ ID No: 1918) |
| 28 | acg gcg gcC cag atc ac | (SEQ ID No: 1919) |

TABLE 10-1-continued

| Probe No. | Base Sequence | |
|---|---|---|
| 29 | gac gtg ggA ccc gac g | (SEQ ID No: 1920) |
| 30 | g agg atg taC ggc tgc ga | (SEQ ID No: 1921) |

TABLE 10-2

| Probe No. | Base Sequence | |
|---|---|---|
| 31 | c ctg aag aaT ggg aag gag | (SEQ ID No: 1922) |
| 32 | c ctc cag agC atg tac gg | (SEQ ID No: 1923) |
| 33 | gc ggg tat gTc cag tac g | (SEQ ID No: 1924) |
| 34 | c cga gtg aAc ctg cgg a | (SEQ ID No: 1925) |
| 35 | ctg cgg aaA ctg cgc gg | (SEQ ID No: 1926) |
| 36 | c tgc gac Gtg ggg ccc | (SEQ ID No: 1927) |
| 37 | g gag ggc cTg tgc gtg | (SEQ ID No: 1928) |
| 38 | g aca cag aaC tac aag cgc | (SEQ ID No: 1929) |
| 39 | cac ttc atc Gca gtg ggc | (SEQ ID No: 1930) |
| 40 | gcc cgt gCg gcg gag | (SEQ ID No: 1931) |
| 41 | g agc gag gAc ggg tct c | (SEQ ID No: 1932) |
| 42 | g gag cag cTg aga gcc t | (SEQ ID No: 1933) |
| 43 | cta gga gct Atg gtg gct | (SEQ ID No: 1934) |
| 44 | g gac gac acA cag ttc gt | (SEQ ID No: 1935) |
| 45 | ga gag ccc cAc ttc atc g | (SEQ ID No: 1936) |
| 46 | g tgc cat gtT cag cac ga | (SEQ ID No: 1937) |
| 47 | ccg cgg gAg ccg tgg | (SEQ ID No: 1938) |
| 48 | tg ggc tac Ctg gac gac | (SEQ ID No: 1939) |
| 49 | ctg ggg ccG gac ggg | (SEQ ID No: 1940) |
| 50 | c gtg tcc Tgg ccc ggc | (SEQ ID No: 1941) |
| 51 | ag gca cag Gct gac cga | (SEQ ID No: 1942) |
| 52 | c gcg gac aAg gcg gct | (SEQ ID No: 1943) |
| 53 | tg aga tgg gGg cca tct t | (SEQ ID No: 1944) |
| 54 | g gag tgg ctG cgc aga ta | (SEQ ID No: 1945) |
| 55 | ac cat gag gTc acc ctg a | (SEQ ID No: 1946) |
| 56 | aac ggg aag Aag acg ctg | (SEQ ID No: 1947) |
| 57 | at aac cag tTc gcc tac ga | (SEQ ID No: 1948) |
| 58 | cgg gcg cGg tgg gtg | (SEQ ID No: 1949) |
| 59 | ggg gag ccC cgg gcg | (SEQ ID No: 1950) |
| 60 | tac acc gcT gtg tcc cg | (SEQ ID No: 1951) |

TABLE 10-3

| Probe No. | Base Sequence | |
|---|---|---|
| 61 | gcg agt ccA aga ggg ga | (SEQ ID No: 1952) |
| 62 | gg gtg gag Aag gag ggg | (SEQ ID No: 1953) |
| 63 | ag agg atg tAt ggc tgc g | (SEQ ID No: 1954) |
| 64 | g cgc aag tTg gag gcg g | (SEQ ID No: 1955) |
| 65 | cag cgc gcA gaa ccc c | (SEQ ID No: 1956) |
| 66 | g gct gcg tGc agc aac a | (SEQ ID No: 1957) |
| 67 | tcc cag ccT acc atc cc | (SEQ ID No: 1958) |
| 68 | ctg gag ggA ctg tgc gt | (SEQ ID No: 1959) |
| 69 | g gag cag gaC aga gcc ta | (SEQ ID No: 1960) |
| 70 | c ggc tac taT aac tag agc | (SEQ ID No: 1961) |
| 71 | c ctc cag aaT atg tat ggc | (SEQ ID No: 1962) |
| 72 | tc acc gct aAg atg tgt ag | (SEQ ID No: 1963) |
| 73 | ag agg atg tTt ggc tgc g | (SEQ ID No: 1964) |
| 74 | at gac cag tTc gcc tac g | (SEQ ID No: 1965) |
| 75 | ggg ctg caA gag ccc c | (SEQ ID No: 1966) |
| 76 | gc tct cag gTt gcg tgc a | (SEQ ID No: 1967) |
| 77 | g gcc cgt Acg gcg gag | (SEQ ID No: 1968) |
| 78 | ctg gag aac Agg aag aag a | (SEQ ID No: 1969) |
| 79 | g gag ggc Gcg tgc gtg | (SEQ ID No: 1970) |
| 80 | c ctc cag agC atg tat gg | (SEQ ID No: 1971) |
| 81 | gag aac ggg Gag aag acg | (SEQ ID No: 1972) |
| 82 | tcc tgg acT gcc gcg g | (SEQ ID No: 1973) |
| 83 | tgg acc gcG gcg gac a | (SEQ ID No: 1974) |
| 84 | gc ttc atc Gca gtg ggc | (SEQ ID No: 1975) |
| 85 | ag tgg atg tAt ggc tgc g | (SEQ ID No: 1976) |
| 86 | cc tac gac gTc aag gat ta | (SEQ ID No: 1977) |
| 87 | c cga gtg Ggc ctg cgg | (SEQ ID No: 1978) |
| 88 | gg tat ttc tCc aca tcc gt | (SEQ ID No: 1979) |
| 89 | ag tgg atg tTt ggc tgc g | (SEQ ID No: 1980) |
| 90 | g aac gag gaT ctg cgc tc | (SEQ ID No: 1981) |

TABLE 10-4

| Probe No. | Base Sequence | |
|---|---|---|
| 91 | c cgc ggg Cat gac cag | (SEQ ID No: 1982) |
| 92 | ccc cga acT ctc ctc ct | (SEQ ID No: 1983) |
| 93 | c cgc ggg Cat gac cag | (SEQ ID No: 1984) |
| 94 | g gag cag cAg aga gcc t | (SEQ ID No: 1985) |
| 95 | g gct gtt gtT atg tgt agg | (SEQ ID No: 1986) |

TABLE 10-4-continued

| Probe No. | Base Sequence | |
|---|---|---|
| 96 | t gtg gtc gcT gct gtg at | (SEQ ID No: 1987) |
| 97 | g gag ccc tGc acc ctg | (SEQ ID No: 1988) |
| 98 | g acc tgg Acc ggc tcc | (SEQ ID No: 1989) |
| 99 | ctg aga tgg Aag ccg tct | (SEQ ID No: 1990) |
| 100 | ct gtc ctg gTt gtc cta g | (SEQ ID No: 1991) |

TABLE 11-1

| Allele Number | Probe Number for Detection | | | | | |
|---|---|---|---|---|---|---|
| Cw*0102 | 0 | 1 | 2 | 3 | | |
| Cw*0103 | 4 | | | | | |
| Cw*0104 | 5 | 6 | 7 | | | |
| Cw*0105 | 8 | | | | | |
| Cw*0106 | 9 | | | | | |
| Cw*0107 | 10 | | | | | |
| Cw*0108 | 11 | | | | | |
| Cw*0109 | 12 | | | | | |
| Cw*020201 | 13 | | | | | |
| Cw*020202 | 14 | | | | | |
| Cw*020203 | 15 | 12 | | | | |
| Cw*020204 | 16 | 17 | 18 | | | |
| Cw*020205 | 16 | 19 | 20 | 17 | 12 | 21 |
| Cw*0203 | 9 | 21 | | | | |
| Cw*0204 | 22 | | | | | |
| Cw*0205 | 16 | 20 | 17 | 12 | 21 | |
| Cw*0206 | 23 | 21 | | | | |
| Cw*030201 | 24 | 18 | | | | |
| Cw*030202 | 20 | 24 | | | | |
| Cw*030301 | 25 | 26 | 27 | | | |
| Cw*030302 | 28 | | | | | |
| Cw*030303 | 29 | | | | | |
| Cw*030401 | 30 | 24 | | | | |
| Cw*030402 | 30 | 31 | 32 | | | |
| Cw*0305 | 33 | 32 | | | | |
| Cw*0306 | 34 | | | | | |
| Cw*0307 | 35 | 36 | 30 | 37 | 38 | 32 |
| Cw*0308 | 39 | 30 | 24 | | | |
| Cw*0309 | 40 | 30 | 38 | 32 | | |
| Cw*0310 | 41 | 30 | 37 | 38 | 32 | |
| Cw*0311 | 25 | 26 | | | | |

TABLE 11-2

| Allele Number | Probe Number for Detection | | | | |
|---|---|---|---|---|---|
| Cw*0312 | 25 | 42 | | | |
| Cw*0313 | 25 | 27 | | | |
| Cw*0314 | 43 | 32 | | | |
| Cw*0315 | 44 | 20 | 38 | 32 | |
| Cw*0316 | 37 | 20 | 17 | 45 | |
| Cw*040101 | 46 | | | | |
| Cw*040102 | 47 | | | | |
| Cw*0403 | 48 | 49 | | | |
| Cw*0404 | 50 | 45 | | | |
| Cw*0405 | 51 | | | | |
| Cw*0406 | 48 | 52 | 45 | | |
| Cw*0407 | 53 | 54 | | | |
| Cw*0408 | 50 | 38 | | | |
| Cw*0410 | 50 | | | | |
| Cw*0501 | 36 | 55 | 56 | | |
| Cw*0502 | 57 | | | | |
| Cw*0503 | 58 | | | | |
| Cw*0504 | 20 | 55 | 59 | | |
| Cw*0505 | 37 | 60 | 55 | 59 | |
| Cw*0506 | 61 | | | | |
| Cw*0602 | 62 | 12 | 7 | | |

TABLE 11-2-continued

| Allele Number | Probe Number for Detection | | | | |
|---|---|---|---|---|---|
| Cw*0603 | 63 | 62 | 20 | 12 | |
| Cw*0604 | 62 | 45 | | | |
| Cw*0605 | 64 | 65 | 20 | 17 | |
| Cw*0606 | 62 | 7 | | | |
| Cw*0607 | 66 | | | | |
| Cw*0608 | 44 | 20 | 17 | 12 | 21 |
| Cw*0609 | 62 | 60 | 12 | | |
| Cw*070101 | 67 | 68 | 69 | 70 | |
| Cw*070102 | 71 | | | | |

TABLE 11-3

| Allele Number | Probe Number for Detection | | | | | |
|---|---|---|---|---|---|---|
| Cw*070201 | 8 | 68 | 70 | | | |
| Cw*0703 | 72 | | | | | |
| Cw*070401 | 73 | 70 | | | | |
| Cw*070402 | 74 | | | | | |
| Cw*0705 | 75 | | | | | |
| Cw*0706 | 75 | | | | | |
| Cw*0707 | 36 | 67 | 20 | 68 | 69 | |
| Cw*0708 | 77 | 20 | 68 | 69 | | |
| Cw*0709 | 36 | 44 | 67 | 20 | 68 | 69 |
| Cw*0710 | 78 | 79 | 20 | 68 | 69 | |
| Cw*0711 | 73 | 80 | | | | |
| Cw*0712 | 73 | | | | | |
| Cw*0713 | 8 | 81 | 68 | 69 | | |
| Cw*0714 | 82 | | | | | |
| Cw*0715 | 8 | 21 | 69 | | | |
| Cw*0716 | 39 | 67 | 20 | 68 | 69 | |
| Cw*0717 | 8 | 83 | | | | |
| Cw*0718 | 84 | | | | | |
| Cw*080101 | 85 | 56 | | | | |
| Cw*080102 | 86 | 60 | 87 | | | |
| Cw*0802 | 55 | 56 | | | | |
| Cw*0803 | 88 | 7 | | | | |
| Cw*0804 | 55 | 45 | 59 | | | |
| Cw*0805 | 54 | 60 | 55 | 59 | | |
| Cw*0806 | 89 | 88 | | | | |
| Cw*0807 | 55 | 68 | 59 | | | |
| Cw*0808 | 33 | 59 | | | | |
| Cw*0809 | 90 | | | | | |
| Cw*120201 | 86 | 5 | 7 | | | |
| Cw*120202 | 86 | 5 | 6 | 7 | | |
| Cw*120203 | 67 | 5 | | | | |
| Cw*120301 | 54 | 91 | 7 | | | |

TABLE 11-4

| Allele Number | Probe Number for Detection | | | | | |
|---|---|---|---|---|---|---|
| Cw*120302 | 92 | 12 | | | | |
| Cw*120401 | 93 | 54 | 36 | 94 | 20 | 17 | 12 |
| Cw*120402 | 54 | 36 | 91 | 7 | | |
| Cw*1205 | 36 | 91 | 7 | | | |
| Cw*1206 | 95 | | | | | |
| Cw*1207 | 96 | | | | | |
| Cw*1208 | 39 | 86 | 5 | 6 | 7 | |
| Cw*140201 | 97 | 20 | 27 | | | |
| Cw*140202 | 97 | 98 | 20 | | | |
| Cw*1403 | 97 | 64 | 20 | 27 | | |
| Cw*1404 | 97 | 99 | 98 | 20 | 100 | |
| Cw*1405 | 97 | 94 | 20 | 100 | | |
| Cw*150201 | 23 | 7 | | | | |
| Cw*150202 | 48 | 39 | 36 | 101 | 23 | 45 |
| Cw*1503 | 54 | 23 | 7 | | | |
| Cw*1504 | 20 | 45 | 7 | | | |
| Cw*150501 | 102 | | | | | |
| Cw*150502 | 101 | 103 | 7 | | | |
| Cw*1506 | 101 | 7 | | | | |
| Cw*1507 | 48 | 39 | 101 | 23 | 45 | |
| Cw*1508 | 48 | 39 | 36 | 30 | 101 | 23 |
| Cw*1509 | 101 | 104 | 45 | | | |

TABLE 11-4-continued

| Allele Number | Probe Number for Detection | | | | |
|---|---|---|---|---|---|
| Cw*1510 | 39 | 36 | 101 | 23 | 45 |
| Cw*1511 | 16 | 48 | 36 | 101 | 23 | 45 |
| Cw*1601 | 105 | 106 | | | |
| Cw*1602 | 36 | 105 | 106 | | |
| Cw*160401 | 107 | 106 | | | |
| Cw*1701 | 108 | | | | |
| Cw*1702 | 109 | | | | |
| Cw*1703 | 110 | | | | |
| Cw*1801 | 111 | 112 | | | |
| Cw*1802 | 62 | 100 | 111 | | |

TABLE 12-1

| Allele Number | Probe Number for Detection | | | | |
|---|---|---|---|---|---|
| Cw*0102 | 0 | 1 | 2 | 3 | |
| Cw*0103 | 4 | | | | |
| Cw*0104 | 5 | 6 | 7 | | |
| Cw*0105 | 8 | | | | |
| Cw*0106 | 9 | | | | |
| Cw*0107 | 10 | | | | |
| Cw*0108 | 11 | | | | |
| Cw*0109 | 12 | | | | |
| Cw*020201 | 13 | | | | |
| Cw*020202 | 14 | | | | |
| Cw*020203 | 15 | 12 | | | |
| Cw*020204 | 16 | 17 | 18 | | |
| Cw*020205 | 16 | 19 | 20 | 17 | 12 | 21 |
| Cw*0203 | 9 | 21 | | | |
| Cw*0204 | 22 | | | | |
| Cw*0205 | 16 | 20 | 17 | 12 | 21 |
| Cw*0206 | 23 | 21 | | | |
| Cw*030201 | 24 | 18 | | | |
| Cw*030202 | 20 | 24 | | | |
| Cw*030301 | 25 | 26 | 27 | | |
| Cw*030302 | 28 | | | | |
| Cw*030303 | 29 | | | | |
| Cw*030401 | 26 | 24 | | | |
| Cw*030402 | 26 | 30 | 31 | | |
| Cw*0305 | 32 | 31 | | | |
| Cw*0306 | 33 | | | | |
| Cw*0307 | 34 | 35 | 26 | 36 | 37 | 31 |
| Cw*0308 | 38 | 26 | 24 | | |
| Cw*0309 | 39 | 26 | 37 | 31 | |
| Cw*0310 | 35 | 26 | 36 | 37 | 31 |
| Cw*0311 | 25 | 26 | | | |

TABLE 12-2

| Allele Number | Probe Number for Detection | | | | |
|---|---|---|---|---|---|
| Cw*0312 | 25 | 23 | | | |
| Cw*0313 | 25 | 27 | | | |
| Cw*0314 | 40 | 31 | | | |
| Cw*0315 | 41 | 20 | 37 | 31 | |
| Cw*0316 | 36 | 20 | 17 | 42 | |
| Cw*040101 | 43 | | | | |
| Cw*040102 | 44 | | | | |
| Cw*0403 | 45 | 46 | | | |
| Cw*0404 | 47 | 42 | | | |
| Cw*0405 | 48 | | | | |
| Cw*0406 | 45 | 49 | 42 | | |
| Cw*0407 | 50 | 51 | | | |
| Cw*0408 | 47 | 37 | | | |
| Cw*0410 | 47 | | | | |
| Cw*0501 | 35 | 52 | 53 | | |
| Cw*0502 | 54 | | | | |
| Cw*0503 | 55 | | | | |
| Cw*0504 | 20 | 52 | 56 | | |
| Cw*0505 | 36 | 57 | 52 | 56 | |
| Cw*0506 | 58 | | | | |
| Cw*0602 | 59 | 12 | 7 | | |
| Cw*0603 | 60 | 59 | 20 | 12 | |

TABLE 12-2-continued

| Allele Number | Probe Number for Detection | | | | |
|---|---|---|---|---|---|
| Cw*0604 | 59 | 42 | | | |
| Cw*0605 | 61 | 59 | 20 | 17 | |
| Cw*0606 | 59 | 7 | | | |
| Cw*0607 | 62 | | | | |
| Cw*0608 | 41 | 20 | 17 | 12 | 21 |
| Cw*0609 | 59 | 57 | 12 | | |
| Cw*070101 | 63 | 64 | 65 | 66 | |
| Cw*070102 | 67 | | | | |
| Cw*070201 | 8 | 64 | 66 | | |

TABLE 12-3

| Allele Number | Probe Number for Detection | | | | |
|---|---|---|---|---|---|
| Cw*0703 | 68 | | | | |
| Cw*070401 | 69 | 66 | | | |
| Cw*070402 | 70 | | | | |
| Cw*0705 | 71 | | | | |
| Cw*0706 | 72 | | | | |
| Cw*0707 | 38 | 35 | 40 | 42 | |
| Cw*0708 | 73 | 40 | 42 | | |
| Cw*0709 | 38 | 35 | 41 | 40 | 42 |
| Cw*0710 | 26 | 8 | 20 | 64 | 42 |
| Cw*0711 | 69 | 66 | | | |
| Cw*0712 | 69 | | | | |
| Cw*0713 | 8 | 74 | 64 | 42 | |
| Cw*0714 | 30 | 64 | 40 | 42 | |
| Cw*0715 | 8 | 21 | | | |
| Cw*0716 | 38 | 40 | 42 | | |
| Cw*0717 | 8 | 75 | | | |
| Cw*0718 | 76 | | | | |
| Cw*080101 | 42 | 53 | | | |
| Cw*080102 | 30 | 57 | 77 | | |
| Cw*0802 | 52 | 53 | | | |
| Cw*0803 | 78 | 7 | | | |
| Cw*0804 | 52 | 42 | 56 | | |
| Cw*0805 | 51 | 57 | 52 | 56 | |
| Cw*0806 | 79 | 78 | | | |
| Cw*0807 | 52 | 64 | 56 | | |
| Cw*0808 | 80 | 56 | | | |
| Cw*0809 | 81 | | | | |
| Cw*120201 | 30 | 5 | 7 | | |
| Cw*120202 | 30 | 5 | 6 | 7 | |
| Cw*120203 | 63 | 5 | | | |
| Cw*120301 | 51 | 82 | 7 | | |

TABLE 12-4

| Allele Number | Probe Number for Detection | | | | | |
|---|---|---|---|---|---|---|
| Cw*120302 | 83 | 12 | | | | |
| Cw*120401 | 84 | 51 | 35 | 85 | 20 | 17 | 12 |
| Cw*120402 | 51 | 35 | 82 | 7 | | |
| Cw*1205 | 35 | 82 | 7 | | | |
| Cw*1206 | 86 | | | | | |
| Cw*1207 | 87 | | | | | |
| Cw*1208 | 38 | 30 | 5 | 6 | 7 | |
| Cw*140201 | 88 | 20 | 27 | | | |
| Cw*140202 | 88 | 89 | 20 | | | |
| Cw*1403 | 88 | 61 | 20 | 27 | | |
| Cw*1404 | 88 | 34 | 89 | 20 | 90 | |
| Cw*1405 | 88 | 85 | 20 | 90 | | |
| Cw*150201 | 23 | 7 | | | | |
| Cw*150202 | 45 | 38 | 35 | 91 | 23 | 42 |
| Cw*1503 | 51 | 23 | 7 | | | |
| Cw*1504 | 20 | 42 | 7 | | | |
| Cw*150501 | 92 | | | | | |
| Cw*150502 | 91 | 74 | 7 | | | |
| Cw*1506 | 91 | 7 | | | | |
| Cw*1507 | 45 | 38 | 91 | 23 | 42 | |
| Cw*1508 | 45 | 38 | 35 | 26 | 91 | 23 |
| Cw*1509 | 91 | 20 | 42 | | | |
| Cw*1510 | 38 | 35 | 91 | 23 | 42 | |

TABLE 12-4-continued

| Allele Number | Probe Number for Detection | | | | |
|---|---|---|---|---|---|
| Cw*1511 | 16 | 45 | 35 | 91 | 23 | 42 |
| Cw*1601 | 94 | 95 | | | | |
| Cw*1602 | 35 | 94 | 95 | | | |
| Cw*160401 | 12 | 95 | | | | |
| Cw*1701 | 96 | | | | | |
| Cw*1702 | 97 | | | | | |
| Cw*1703 | 98 | | | | | |
| Cw*1801 | 99 | 100 | | | | |
| Cw*1802 | 59 | 90 | 99 | | | |

Example 7

Probes for Identification of HLA-DP Allele

Extraction of DNA from 1 ml of human blood was performed using GFX Genomic Blood DNA Purification Kit from Amersham Biosciences in the same manner as in Example 1.

Next, quantitative PCR was carried out in the same manner as in Example 1 except that probes in the probe list 1 in Tables 13-1 to 13-3 or 14-1 to 14-3 were used and 3 µl of the mixed primers contains 1 µl of respective solutions of the following primers (10 pmol/µl):

| AAACACGGTCACCTCAGGGGAT | (SEQ ID NO: 2242) |
| GGCCTGAGTGTGGTTGGAACG | (SEQ ID NO: 2243) |
| CCAGCTCGTAGTTGTGTCTGCA | (SEQ ID NO: 2244) |

After PCR amplification, referring to Amp Plot and Dissociation curves on a display of 5700 software, and to the list in Table 15-1 for the probes in Table 13-1, or to the list in Tables 15-2 to 15-5 for the probes in Tables 13-2 to 13-3, it was identified as DPA1*010301 and DPB1*0901.

Example 8

Extraction of DNA from 1 ml of human blood was performed in the same way as in Example 1. PCR of human HLA-DP was then performed in the same manner as in Example 2 except that 6 µl of the mixed primer consisting of 1 µl each of the solutions containing the following sequences at 10 pmol/µl respectively and 9 µl of ultra pure water.

| AAACACGGTCACCTCAGGGGAT | (SEQ ID NO: 2242) |
| GGCCTGAGTGTGGTTGGAACG | (SEQ ID NO: 2243) |
| CCAGCTCGTAGTTGTGTCTGCA | (SEQ ID NO: 2244) |
| CCATGTGTCAACTTATGCC | (SEQ ID NO: 2245) |
| AGAATTACCTTTTCCAG | (SEQ ID NO: 2247) |
| AGAATTACGTTTTCCAG | (SEQ ID NO: 2248) |

At the same time, a DNA microarray was prepared to identify the allele in the specimen described above in the same manner as in Example 2, except that probes in Tables 14-1 and 14-2 were used to form the probe spots respectively.

Then, hybridization was performed using the above specimen and the prepared DNA microarray in the same manner as in Example 2. Fluorometry measurement was conducted with GenePix4000B (Axon). Referring to the list in Table 16-1 when the probes in Table 14-1 were used, or to the list in Tables 16-2 to 16-5 when the probes in Table 14-2 were used, the sample was identified as DPA1*010301 and DPB1*0901.

```
Allele list
DPA1*010301:
                                                    (SEQ ID NO: 1998)
ccatgtgtcaacttatgccgcgtttgtacagacgcatagaccaacaggGgagtttatgtttgaatttgatgaAgat gagatgttctatgtggatctggacaagaaggagaccgtctggcatctggaggagtttggccAagccttttcctttg aggctcagggcgggctggctaacattgctatattgaacaacaacttgaataccttgatccagcgttccaaccacac tcaggccaccaac;

DPA1*010302:
                                                    (SEQ ID NO: 1999)
gcgtttgtacagacgcatagaccaacaggAgagtttatgtttgaatttgatgaagatgagatgttctatgtggatc tggacaagaaggagaccgtctggcatctggaggagtttggccaagccttttcctttgaggctcagggcgggctggc taacattgctatattgaacaacaacttgaataccttgatccagcgttccaaccacactcaggccaccaac;

DPA1*0104:
                                                    (SEQ ID NO: 2000)
gccgcgtttgtacagacgcatagaccaacaggggagtttatgtttgaatttgatgaCgatgagatgttctatgtgg atctggacaagaaggagaccgtctggcatctggaggagtttggccaagccttttcctttgaggctcagggcgggct ggctaacattgctatattgaacaacaacttgaataccttgatccagcgttccaaccacactcaggccaccaac;

DPA1*0105:
                                                    (SEQ ID NO: 2001)
gccgcgtttgtacagacgcatagaccaacaggggagtttatgtttgaatttgatgaagatgagatgttctatgtgg atctggacaagaaggagaccgtctggcatctggaggagtttggccaagccttttcctttgaggctcagggcgggct ggctaacattgctatattgaacaacaacttgaataccttgatccagcgttccaaccacactcaggccgccaaT;
```

-continued

DPA1*0106:
(SEQ ID NO: 2002)
ccatgtgtcaacttatgccgcgtttgtacagacgcatagaccaacaggggagtttatgtttgaatttgatgaagat gagcagttctatgtggatctggataaAaaggagaccgtctggcatctggaggagtttggccaagccttttcctttg aggctcagggcgggctggctaacattgctatattgaacaacaacttgaataccttgatccagcgttccaaccacac tcaggccaccaac;

DPA1*0107:
(SEQ ID NO: 2003)
catgtgtcaacttatgccgcgtttgtacagacgcatagaccaacaggggagtttatgtttgaatttgatgaagatg agatgttctatgtggatctggacaagaaggagaccgtctggcatctggaggagtttggccaaAccttttcctttga ggctcagggcgggctggctaacattgctatattgaacaacaacttgataccttgatccagcgttccaaccacact caggccaccaac;

DPA1*0108:
(SEQ ID NO: 2004)
ccatgtgtcaacttatgccgcgtttgtacagacgcatagaccaacaggggagtttatgtttgaatttgatgaCgat gagatgttctatgtggatctggacaagaaggagaccgtctggcatctggaggagtttggccGagccttttcctttg aggctcagggcgggctggctaacattgctatattgaacaacaacttgaataccttgatccagcgttccaaccacac tcaggccaccaac;

DPA1*020101:
(SEQ ID NO: 2005)
ccatgtgtcaacttatgccgcgtttgtacagaCcatagaccaacaggggagtttatgtttgaatttgatgaagat gagcagttctatgtggatctggataaAaaggagaccgtctggcatctggaggagtttggccgagccttttcctttg aggctcagggcgggctggctaacattgctatattgaacaacaacttgaataccttgatccagcgttccaaccacac tcaggccgccaaT;

DPA1*020102:
(SEQ ID NO: 2006)
ccatgtgtcaacttatgccgcgtttgtacagacgcatagaccaacaggggagtttatgtttgaatttgatgaagat gagcagttctatgtggatctggataaAaaggagaccgtctggcatctggaggagtttggccgagccttttcctttg aggctcagggcgggctggctaacattgctatattgaacaacaacttgaataccttgatccagcgttccaaccacac tcaggccgccaaT;

DPA1*020103:
(SEQ ID NO: 2007)
ccatgtgtcaacttatgccgcgtttgtacagacgcatagaccaacaggggagtttatgtttgaatttgatgaagat gagcAgttctatgtggatctggacaagaaggagaccgtctggcatctggaggagtttggccgagccttttcctttg aggctcagggcgggctggctaacattgctatattgaacaacaacttgaataccttgatccagcgttccaaccacac tcaggccgccaaT;

DPA1*020104:
(SEQ ID NO: 2008)
gcgtttgtacaaacccatagaccaacaggggagtttatgtttgaatttgatgaagatgagcagttctatgtggatc tggataaAaaggagaccgtctggcatctggaggagtttggccgagccttttcctttgaggctcagggcgggctggc taacattgctatattgaacaacaacttgaataccttgatccagcgttccaaccacactcaggccgccaaT;

DPA1*020105:
(SEQ ID NO: 2009)
ccatgtgtcaacttatgccgcgtttgtacagacgcatagaccaacaggAgagtttatgtttgaatttgatgaagat gagcAgttctatgtggatctggacaagaaggagaccgtctggcatctggaggagtttggccgagccttttcctttg aggctcagggcgggctggctaacattgctatattgaacaacaacttgaataccttgatccagcgttccaaccacac tcaggccgccaaT;

DPA1*020106:
(SEQ ID NO: 2010)
ccatgtgtcaacttatgccgcgtttgtacagacCcatagaccaacaggggagtttatgtttgaatttgatgaagat
gagcagttctatgtggatctggaTaagaaggagaccgtctggcatctggaggagtttggccgagccttttcctttg
aggctcagggcgggctggctaacattgctatattgaacaacaacttgaataccttgatccagcgttccaaccacac
tcaggccgccaaT;

DPA1*020201:
(SEQ ID NO: 2011)
aacttatgccatgtttgtacagacccatagaccaacaggAgagtttatgtttgaatttgatgaagatgagcagttc
tatgtggatctggaTaagaaggagaccgtctggcatctggaggagtttggccgagccttttcctttgaggctcagg
gcgggctggctaacattgctatattgaacaacaacttgaataccttgatccagcgttccaaccacactcaggccgc
caaT;

DPA1*020202:
(SEQ ID NO: 2012)
ccatgtgtcaacttatgccatgtttgtacagacCcatagaccaacaggAgagtttatgtttgaatttgatgaagat
gagcAgttctatgtggatctggacaagaaggagaccgtctggcatctggaggagtttggccgagccttttcctttg
aggctcagggcgggctggctaacattgctatattgaacaacaacttgaataccttgatccagcgttccaaccacac
tcaggccgccaaT;

DPA1*020203:
(SEQ ID NO: 2013)
atgtgtcaacttatgccaTgtttgtacagacccatagaccaacaggggagtttatgtttgaatttgatgaagatga
gcagttctatgtggatctggacaagaaggagaccgtctggcatctggaggagtttggccgagccttttcctttgag
gctcagggcgggctggctaacattgctatattgaacaacaacttgaataccttgatccagcgttccaaccacactc
aggccgccaaT;

DPA1*0203:
(SEQ ID NO: 2014)
ccatgtgtcaacttatgccgcgtttgtacagacCcatagaccaacaggggagtttatgtttgaatttgatgaagat
gagatgttctatgtggatctggacaagaaggagaccgtctggcatctggaggagtttggccgagccttttcctttg
aggctcagggcgggctggctaacattgctatattgaacaacaacttgaataccttgatccagcgttccaaccacac
tcaggccgccaaT;

DPA1*0301:
(SEQ ID NO: 2015)
gccatgtttgtacagacccatagaccaacaggggagtttatgtttgaatttgatgaagatgagatgttctatgtgg
atctggacaagaaggagaccgtctggcatctggaggagtttggccaagccttttcctttgaggctcagggcgggct
ggctaacattgctatatCgaacaacaacttgaataccttgatccagcgttccaaccacactcaggccaccaac;

DPA1*0302:
(SEQ ID NO: 2016)
ccatgtgtcaacttatgccaTgtttgtacagacccatagaccaacaggggagtttatgtttgaatttgatgaagat
gagatgttctatgtggatctggacaagaaggagaccgtctggcatctggaggagtttggccaagccttttcctttg
aggctcagggcgggctggctaacattgctatattgaacaacaacttgaataccttgatccagcgttccaaccacac
tcaggccaccaac;

DPA1*0401:
(SEQ ID NO: 2017)
gccgcgtttgtacagacgcatagaacaacaggagagtttatgtttgagtttgatgatgatgagatgttctatgtgg
atctggacaagaaggagaccgtctggcatctggaggagtttggccgagccttttcctttgaggctcagggcgggct
ggctaacattgctatattgaacaacaacttgaatatcgcTatccagcgttccaaccacactcaggccgccaat;

DPB1*010101:
(SEQ ID NO: 2018)
agaattacgtgtaccagggacggcaggaatgctacgcgtttaatgggacacagcgcttcctggagagatacatcta -continued caaccgggaggagtacgcgcgcttcgacagcgacgtgggggagttccgggcggtgacggagctggggcggcctgct gcggagtactggaacagccagaaggacatcctggaggagaagcgggcagtgccggacaggGtAtgcagacacaact acgagctggacgaggccgtgaccctgcagcgccgagtcc;

DPB1*010102:

(SEQ ID NO: 2019)

aattacgtgtaccagggacggcaggaatgctacgcgtttaatgggacacagcgcttcctggagagatacatctaca accgggaggagtacgcgcgcttcgacagcgacgtgggAgagttccgggcggtgacggagctggggcggcctgctgc ggagtactggaacagccagaaggacatcctggaggagaagcgggcagtgccggacagggtatgcagacacaactac gagctggacgaggccgtgaccctgcagcgccga;

DPB1*020102 (SEQ ID NO: 2020):

(SEQ ID NO: 2021)

agaattaccttttccagggacggcaggaatgctacgcgtttaatgggacacagcgcttcctggagagatacatcta caaccgggaggagttcgTgcgcttcgacagcgacgtgggggagttccgggcggtgacggagctggggcggcctgat gAggagtactggaacagccagaaggacatcctggaggagGagcgggcagtgccggacaggatGtgcagacacaact acgagctggGcgggcccatgaccctgcagcgccgagtcc;

DPB1*020103:

(SEQ ID NO: 2022)

agaattaccttttccagggacggcaggaatgctacgcgtttaatgggacacagcgcttcctggagagatacatcta caaccgggaggagttcgtgcgcttcgacagcgacgtgggggagttccgggcggtgacggagctggggcggcctgaC gaggagtactggaacagccagaaggacatcctggaggaggagcgggcagtgccggacaggatgtgcagacacaact acgagctgggcgggcccatgaccctgcagcgccgag;

DPB1*020104:

(SEQ ID NO: 2023)

agaattaccttttccagggacggcaggaatgctacgcgtttaatgggacacagcgcttcctggagagatacatcta caaccgggaggagttcgtgcgcttcgacagcgacgtgggggagttccgggcggtgacggagctggggcggcctgat gaggagtactggaacagccagaaggacatcctggaggaggagcgggcagtTccggacaggatgtgcagacacaact acgagctgggcgggcccatgaccctgcagcgccga;

DPB1*020105:

(SEQ ID NO: 2024)

agaattaccttttccagggacggcaggaatgctacgcgtttaatgggacacagcgcttcctggagagatacatcta caaccgggaAgagttcgtgcgcttcgacagcgacgtgggggagttccgggcggtgacggagctggggcggcctgat gaggagtactggaacagccagaaggacatcctggaggaggagcgggcagtgccggacaggatgtgcagacacaact acgagctgggcgggcccatgaccctgcagcgccgag;

DPB1*020106:

(SEQ ID NO: 2025)

agaattaccttttccagggacggcaggaatgctacgcgtttaatgggacacagcgcttcctggagagatacatcta caaccgggaggagttTgtgcgcttcgacagcgacgtgggggagttccgggcggtgacggagctggggcggcctgat gaggagtactggaacagccagaaggacatcctggaggaggagcgggcagtgccggacaggatgtgcagacacaact acgagctgggcgggcccatgaccctgcagcgccgag;

DPB1*0202:

(SEQ ID NO: 2026)

agaattaccttttccagggacggcaggaatgctacgcgtttaatgggacacagcgcttcctggagagatacatcta caaccgggaggagCtcgtgcgcttcgacagcgacgtgggggagttccgggcggtgacggagctggggcggcctgaG gcggagtactggaacagccagaaggacatcctggaggagGagcgggcagtgccggacaggatgtgcagacacaact acgagctgggcgggcccAtgaccctgcagcgccgag;

DPB1*030101:

(SEQ ID NO: 2027)

agaattacgtgtaccagtTacggcaggaatgctacgcgtttaatgggacacagcgcttcctggagagatacatcta caaccgggaggagttcgTgcgcttcgacagcgacgtgggggagttccgggcggtgacggagctggggcggcctgat gaggaCtactggaacagccagaaggacCtcctggaggagaagcgggcagtgccggacagggtatgcagacacaact acgagctggacgaggccgtgaccctgcagcgccgagtcc;

DPB1*030102:
(SEQ ID NO: 2028)
agaattacgtgtaccagttacggcaggaatgctacgcgtttaatgggacacagcgcttcctggagagatacatcta caaccgggaggagttcgtgcgcttcgacagcgacgtgggggagttccgggcggtgacggagctggggcggcctgat gaggactactggaacagccagaaggacctcctggaggagaagcgggcagtgccggacagggtatgcagacacaact acgagctggacgaggccgtgaccctAcagcgccgag;

DPB1*0401:
(SEQ ID NO: 2029)
agaattaccttttccagggacggcaggaatgctacgcgtttaatgggacacagcgcttcctggagagatacatcta caaccgggaggagtTcgcgcgcttcgacagcgacgtgggggagttccgggcggtgacggagctggggcggcctgct gcggagtactggaacagccagaaggacatcctggaggagaagcgggcagtgccggacaggatGtgcagacacaact acgagctggGcgggcccatgaccctgcagcgccgagtcc;

DPB1*0402:
(SEQ ID NO: 2030)
agaattaccttttccagggacggcaggaatgctacgcgtttaatgggacacagcgcttcctggagagatacatcta caaccgggaggagttcgTgcgcttcgacagcgacgtgggggagttccgggcggtgacggagctggggcggcctgat gAggagtactggaacagccagaaggacatcctggaggagaagcgggcagtgccggacaggatGtgcagacacaact acgagctggGcgggcccatgaccctgcagcgccgagtcc;

DPB1*0501:
(SEQ ID NO: 2031)
agaattaccttttccagggacggcaggaatgctacgcgtttaatgggacacagcgcttcctggagagatacatcta caaccgggaggagCtcgTgcgcttcgacagcgacgtgggggagttccgggcggtgacggagctggggcggcctgaG gcggagtactggaacagccagaaggacatcctggaggagaagcgggcagtgccggacaggatGtgcagacacaact acgagctggacgaggccgtgaccctgcagcgccgag;

DPB1*0601:
(SEQ ID NO: 2032)
agaattacgtgtaccagttacggcaggaatgctacgcgtttaatgggacacagcgcttcctggagagatacatcta caaccgggaggagttcgtgcgcttcgacagcgacgtgggggagttccgggcggtgacggagctggggcggcctgat gaggaCtactggaacagccagaaggacCtcctggaggagGagcgggcagtgccggacaggatGtgcagacacaact acgagctggacgaggccgtgaccctgcag;

DPB1*0801:
(SEQ ID NO: 2033)
cttttccagggacggcaggaatgctacgcgtttaatgggacacagcgcttcctggagagatacatctacaaccggg aggagttcgTgcgcttcgacagcgacgtgggggagttccgggcggtgacggagctggggcggcctgatgAggagta ctggaacagccagaaggacatcctggaggagGagcgggcagtgccggacagggtatgcagacacaactacgagctg gacgaggccgtgaccctgcag;

DPB1*0901:
(SEQ ID NO: 2034)
agaattacgtgcaccagtTacggcaggaatgctacgcgtttaatgggacacagcgcttcctggagagatacatcta caaccgggaggagttcgtgcgcttcgacagcgacgtgggggagttccgggcggtgacggagctggggcggcctgat gaggaCtactggaacagccagaaggacatcctggaggagGagcgggcagtgccggacagggtatgcagacacaact acgagctggacgaggccgtgaccctgcagcgccgag;

DPB1*1001:
(SEQ ID NO: 2035)
agaattacgtgcaccagtTacggcaggaatgctacgcgtttaatgggacacagcgcttcctggagagatacatcta caaccgggaggagttcgTgcgcttcgacagcgacgtgggggagttccgggcggtgacggagctggggcggcctgat

```
gAggagtactggaacagccagaaggacatcctggaggagGagcgggcagtgccggacagggtatgcagacacaact acgagctggacgaggccgtgaccctgcagcgccgag;

DPB1*110101:
                                                                (SEQ ID NO: 2036)
gtgtaccagttacggcaggaatgctacgcgtttaatgggacacagcgcttcctggagagatacatctacaaccggC aggagtacgcgcgcttcgacagcgacgtgggagagttccgggcggtgacggagctggggcggcctgctgcggagta ctggaacagccagaaggacctcctggaggagaggcgggcagtgccggacaggatgtgcagacacaactacgagctg gacgaggccgtgaccctgcag;

DPB1*110102:
                                                                (SEQ ID NO: 2037)
agaattacgtgtaccagttacggcaggaatgctacgcgtttaatgggacacagcgcttcctggagagatacatcta caacAggcaggagtacgcgcgcttcgacagcgacgtgggagagttccgggcggtgacggagctggggcggcctgct gcggagtactggaacagccagaaggacctcctggaggagaggcgggcagtgccggacaggatgtgcagacacaact acgagctggacgaggccgtgaccctgcag;

DPB1*1301:
                                                                (SEQ ID NO: 2038)
agaattacgtgtaccagtTacggcaggaatgctacgcgtttaatgggacacagcgcttcctggagagatacatcta caaccgggaggagtacgcgcgcttcgacagcgacgtggggagttccgggcggtgacggagctggggcggcctgct gcggagtactggaacagccagaaggacatcctggaggagGagcgggcagtgccggacaggAtatgcagacacaact acgagctggacgaggccgtgaccctgcag;

DPB1*1401:
                                                                (SEQ ID NO: 2039)
agaattacgtgcaccagtTacggcaggaatgctacgcgtttaatgggacacagcgcttcctggagagatacatcta caaccgggaggagttcgTgcgcttcgacagcgacgtggggagttccgggcggtgacggagctggggcggcctgat gaggaCtactggaacagccagaaggacCtcctggaggagaagcgggcagtgccggacagggtatgcagacacaact acgagctggacgaggccgtgaccctgcag;

DPB1*1501:
                                                                (SEQ ID NO: 2040)
agaattacgtgtaccagggacggcaggaatgctacgcgtttaatgggacacagcgcttcctggagagatacatcta caaccggCaggagtacgcgcgcttcgacagcgacgtgggagagttccgggcggtgacggagctggggcggcctgct gcggagtactggaacagccagaaggacctcctggaggagaggcgggcagtgccggacaggatgtgcagacacaact acgagctggtcgggcccAtgaccctgcagcgccgag;

DPB1*1601:
                                                                (SEQ ID NO: 2041)
agaattacctttcccagggacggcaggaatgctacgcgtttaatgggacacagcgcttcctggagagatacatcta caaccgggaggagttcgTgcgcttcgacagcgacgtggggagttccgggcggtgacggagctggggcggcctgat gAggagtactggaacagccagaaggacatcctggaggagGagcgggcagtgccggacaggatGtgcagacacaact acgagctggacgaggccgtgaccctgcagcgccgag;

DPB1*1701:
                                                                (SEQ ID NO: 2042)
agaattacgtgcaccagtTacggcaggaatgctacgcgtttaatgggacacagcgcttcctggagagatacatcta caaccgggaggagttcgtgcgcttcgacagcgacgtggggagttccgggcggtgacggagctggggcggcctgat gaggaCtactggaacagccagaaggacatcctggaggagGagcgggcagtgccggacaggatGtgcagacacaact acgagctggacgaggccgtgaccctgcagcgccgag;

DPB1*1801:
                                                                (SEQ ID NO: 2043)
gtgtaccagggacggcaggaatgctacgcgtttaatgggacacagcgcttcctggagagatacatctacaaccggg aggagttcgTgcgcttcgacagcgacgtggggagttccgggcggtgacggagctggggcggcctgatgAggagta
``` ctggaacagccagaaggacatcctggaggagaagcgggcagtgccggacaggatgtgcagacacaactacgagctg gTcgggcccatgaccctgcag;

DPB1*1901:

(SEQ ID NO: 2044)

agaattacctttccagggacggcaggaatgctacgcgtttaatgggacacagcgcttcctggagagatacatcta caaccgggaggagttcgtgcgcttcgacagcgacgtgggggagttccgggcggtgacggagctggggcggcctgaG gcggagtactggaacagccagaaggacatcctggaggagGagcgggcagtgccggacaggAtatgcagacacaact acgagctggacgaggccgtgaccctgcagcgccgag;

DPB1*200101:

(SEQ ID NO: 2045)

agaattacgtgtaccagttacggcaggaatgctacgcgtttaatgggacacagcgcttcctggagagatacatcta caaccgggaggagttcgtgcgcttcgacagcgacgtgggggagttccgggcggtgacggagctggggcggcctgat gaggaCtactggaacagccagaaggacCtcctggaggagaagcgggcagtgccggacaggatGtgcagacacaact acgagctggacgaggccgtgaccctgcagcgccgag;

DPB1*200102:

(SEQ ID NO: 2046)

agaattacgtgtaccagttacggcaggaatgctacgcgtttaatgggacacagcgcttcctggagagatacatcta caaccgggaggagttcgtgcgcttcgacagcgacgtgggggagttccgggcggtgacggagctggggcggcctgat gaggactactggaacagccagaaggacctcctggaggagaagcgggcagtgccggacaggatgtgcagacacaact acgagctggacgaggccgtgaccctgcagcgTcga;

DPB1*2101:

(SEQ ID NO: 2047)

agaattacgtgtaccagtTacggcaggaatgctacgcgtttaatgggacacagcgcttcctggagagatacatcta caaccgggaggagCtcgtgcgcttcgacagcgacgtgggggagttccgggcggtgacggagctggggcggcctgaG gcggagtactggaacagccagaaggacatcctggaggagGagcgggcagtgccggacaggatGtgcagacacaact acgagctggacgaggccgtgaccctgcagcgccgag;

DPB1*2201:

(SEQ ID NO: 2048)

agaattacctttccagggacggcaggaatgctacgcgtttaatgggacacagcgcttcctggagagatacatcta caaccgggaggagCtcgtgcgcttcgacagcgacgtgggggagttccgggcggtgacggagctggggcggcctgaG gcggagtactggaacagccagaaggacatcctggaggagGagcgggcagtgccggacaggatGtgcagacacaact acgagctggacgaggccgtgaccctgcagcgccgag;

DPB1*2301:

(SEQ ID NO: 2049)

agaattacctttccagggacggcaggaatgctacgcgtttaatgggacacagcgcttcctggagagatacatcta caaccgggaggagttcgTgcgcttcgacagcgacgtgggggagttccgggcggtgacggagctggggcggcctgct gcggagtactggaacagccagaaggacatcctggaggagaagcgggcagtgccggacaggatGtgcagacacaact acgagctggGcgggcccatgaccctgcagcgccgag;

DPB1*2401:

(SEQ ID NO: 2050)

agaattacctttccagggacggcaggaatgctacgcgtttaatgggacacagcgcttcctggagagatacatcta caaccgggaggagttcgcgcgcttcgacagcgacgtgggggagttccgggcggtgacggagctggggcggcctgaG gcggagtactggaacagccagaaggacatcctggaggagaagcgggcagtgccggacaggatgtgcagacacaact acgagctgggcgggcccAtgaccctgcagcgccgag;

DPB1*2501:

(SEQ ID NO: 2051)

agaattacgtgtaccagtTacggcaggaatgctacgcgtttaatgggacacagcgcttcctggagagatacatcta caaccgggaggagttcgTgcgcttcgacagcgacgtgggggagttccgggcggtgacggagctggggcggcctgat

```
gAggagtactggaacagccagaaggacCtcctggaggagaagcgggcagtgccggacagggtatgcagacacaact acgagctggacgaggccgtgaccctgcagcgccgag;

DPB1*260101:
                                                            (SEQ ID NO: 2052)
gtgtaccagttacggcaggaatgctacgcgtttaatgggacacagcgcttcctggagagatacatctacaaccggg aggagtacgcgcgcttcgacagcgacgtgggagagttccgggcggtgacggagctggggcggcctgctgcggagta ctggaacagccagaaggacatcctggaggagaagcgggcagtgccggacagAgtatgcagacacaactacgagctg gacgaggccgtgaccctgcagcgccgag;

DPB1*260102:
                                                            (SEQ ID NO: 2053)
gtgtaccagttacggcaggaatgctacgcgtttaatgggacacagcgcttcctggagagatacatctacaaccggg aggagtacgcgcgcttcgacagcgacgtgggggagttccgggcggtgacggagctggggcggcctgctgcggagta ctggaacagccagaaggacatcctggaggagaagcgggcagtgccggacagggtatgcagacacaactacgagctg gacgaggccgtgaccctgcagcgccga;

DPB1*2701:
                                                            (SEQ ID NO: 2054)
agaattacgtgtaccagtTacggcaggaatgctacgcgtttaatgggacacagcgcttcctggagagatacatcta caaccgggaggagtacgcgcgcttcgacagcgacgtgggggagttccgggcggtgacggagctggggcggcctgct gcggagtactggaacagccagaaggacatcctggaggagaagcgggcagtgccggacaggatGtgcagacacaact acgagctggacgaggccgtgaccctgcagcgccgag;

DPB1*2801:
                                                            (SEQ ID NO: 2055)
agaattaccttttccagggacggcaggaatgctacgcgtttaatgggacacagcgcttcctggagagatacatcta caaccgggaggagttcgcgcgcttcgacagcgacgtgggggagttccgggcggtgacggagctggggcggcctgat gAggagtactggaacagccagaaggacCtcctggaggagaagcgggcagtgccggacaggatgtgcagacacaact acgagctggTcgggcccatgaccctgcagcgccgag;

DPB1*2901:
                                                            (SEQ ID NO: 2056)
agaattacgtgtaccagttacggcaggaatgctacgcgtttaatgggacacagcgcttcctggagagatacatcta caaccgggaggagttcgtgcgcttcgacagcgacgtgggggagttccgggcggtgacggagctggggcggcctgat gaggaCtactggaacagccagaaggacCtcctggaggagGagcgggcagtgccggacagggtatgcagacacaact acgagctggacgaggccgtgaccctgcagcgccgag;

DPB1*3001:
                                                            (SEQ ID NO: 2057)
agaattacgtgcaccagtTacggcaggaatgctacgcgtttaatgggacacagcgcttcctggagagatacatcta caaccgggaggagttcgtgcgcttcgacagcgacgtgggggagttccgggcggtgacggagctggggcggcctgaG gcggagtactggaacagccagaaggacatcctggaggagGagcgggcagtgccggacaggatGtgcagacacaact acgagctggacgaggccgtgaccctgcag;

DPB1*3101:
                                                            (SEQ ID NO: 2058)
agaattaccttttccagggacggcaggaatgctacgcgtttaatgggacacagcgcttcctggagagatacatcta caaccgggaggagttcgcgcgcttcgacagcgacgtgggggagttccgggcggtgacggagctggggcggcctgct gcggagtactggaacagccagaaggacctcctggaggagaagcgggcaTtgccggacaggatgtgcagacacaact acgagctggacgaggccgtgaccctgcagcgccgag;

DPB1*3201:
                                                            (SEQ ID NO: 2059)
agaattaccttttccagggacggcaggaatgctacgcgtttaatgggacacagcgcttcctggagagatacatcta caaccgggaggagttcgtgcgcttcgacagcgacgtgggggagttccgggcggtgacggagctggggcggcctgat
```

DPB1*3301:

(SEQ ID NO: 2060)

agaattaccttttccagggacggcaggaatgctacgcgtttaatgggacacagcgcttcctggagagatacatcta caaccgggaggagttcgcgcgcttcgacagcgacgtgggggagttccgggcggtgacggagctggggcggcctgct gcggagtactggaacagccagaaggacatcctggaggagGagcgggcagtgccggacaggatGtgcagacacaact acgagctggGcgggcccatgaccctgcag;

DPB1*3401:

(SEQ ID NO: 2061)

agaattaccttttccagggacggcaggaatgctacgcgtttaatgggacacagcgcttcctggagagatacatcta caaccgggaggagctcgtgcgcttcgacagcgacgtgggggagttccgggcggtgacggagctggggcggcctgct gcggagtactggaacagccagaaggacctcctggaggagaagcgggcaTtgccggacaggatgtgcagacacaact acgagctggtcgggcccAtgaccctgcag;

DPB1*3501:

(SEQ ID NO: 2062)

agaattacgtgcaccagtTacggcaggaatgctacgcgtttaatgggacacagcgcttcctggagagatacatcta caaccgggaggagttcgTgcgcttcgacagcgacgtgggggagttccgggcggtgacggagctggggcggcctgat gaggaCtactggaacagccagaaggacatcctggaggagaagcgggcagtgccggacagggtatgcagacacaact acgagctggacgaggccgtgaccctgcag;

DPB1*3601:

(SEQ ID NO: 2063)

agaattacgtgtaccagtTacggcaggaatgctacgcgtttaatgggacacagcgcttcctggagagatacatcta caaccgggaggagCtcgTgcgcttcgacagcgacgtgggggagttccgggcggtgacggagctggggcggcctgaG gcggagtactggaacagccagaaggacatcctggaggagaagcgggcagtgccggacaggatGtgcagacacaact acgagctggacgaggccgtgaccctgcagcgccgag;

DPB1*3701:

(SEQ ID NO: 2064)

gtgtaccagttacggcaggaatgctacgcgtttaatgggacacagcgcttcctggagagatacatctacaaccggg aggagttcgTgcgcttcgacagcgacgtgggggagttccgggcggtgacggagctggggcggcctgatgAggagta ctggaacagccagaaggacatcctggaggagGagcgggcagtgccggacagggtatgcagacacaactacgagctg gacgaggccgtgaccctgcagcgccgag;

DPB1*3801:

(SEQ ID NO: 2065)

cttttccagggacggcaggaatgctacCcgtttaatgggacacagcgcttcctggagagatacatctacaaccggg aggagctcgtgcgcttcgacagcgacgtgggggagttccgggcggtgacggagctggggcggcctgaggcggagta ctggaacagccagaaggacatcctggaggagaagcgggcagtgccggacaggatgtgcagacacaactacgagctg gacgaggccgtgaccctgcag;

DPB1*3901:

(SEQ ID NO: 2066)

agaattaccttttccagggacggcaggaatgctacgcgtttaatgggacacagcgcttcctggagagatacatcta caaccgggaggagtacgcgcgcttcgacagcgacgtgggggagttccgggcggtgacggagctggggcggcctgct gcggagtactggaacagccagaaggacatcctggaggagaagcgggcagtgccggacaggatGtgcagacacaact acgagctggGcgggcccatgaccctgcagcgccga;

DPB1*4001:

(SEQ ID NO: 2067)

agaattaccttttccagggacggcaggaatgctacgcgtttaatgggacacagcgcttcctggagagatacatcta caaccgggaggagtacgcgcgcttcgacagcgacgtgggggagttccgggcggtgacggagctggggcggcctgct -continued gcggagtactggaacagccagaaggacatcctggaggagaagcgggcagtgccggacaggatgtgcagacacaact acgagctggTcgggcccatgaccctgcagcgccga;

DPB1*4101:

(SEQ ID NO: 2068)

aattaccttttccagggacggcaggaatgctacgcgtttaatgggacacagcgcttcctggagagatacatctaca accgggaggagttcgtgcgcttcgacagcgacgtgggggagttccgggcggtgacggagctggggcggcctgatga ggagtactggaacagccagaaggacTtcctggaggagGagcgggcagtgccggacaggatgtgcagacacaactac gagctgggcgggcccatgaccctgcagcgccga;

DPB1*4401:

(SEQ ID NO: 2069)

agaattacgtgtaccagttacggcaggaatgctacgcgtttaatgggacacagcgcttcctggagagatacatcta caaccgggaggagCtcgtgcgcttcgacagcgacgtgggggagttccgggcggtgacggagctggggcggcctgat gaggactactggaacagccagaaggacCtcctggaggagGagcgggcagtgccggacagggtatgcagacacaact acgagctggacgaggccgtgaccctgcagcgccgag;

DPB1*4501:

(SEQ ID NO: 2070)

gtgcaccagttacggcaggaatgctacgcgtttaatgggacacagcgcttcctggagagatacatctacaaccggg aggagttcgTgcgcttcgacagcgacgtgggggagttccgggcggtgacggagctggggcggcctgatgAggagta ctggaacagccagaaggacCtcctggaggagaagcgggcagtgccggacagggtatgcagacacaactacgagctg gacgaggccgtgaccctgcag;

DPB1*4601:

(SEQ ID NO: 2071)

agaattaccttttccagggacggcaggaatgctacgcgtttaatgggacacagcgcttcctggagagatacatcta caaccgggaggagttcgtgcgcttcgacagcgacgtgggggagttccgggcggtgacggagctggggcggcctgat gaggaCtactggaacagccagaaggacatcctggaggagGagcgggcagtgccggacaggatgtgcagacacaact acgagctgggcgggcccAtgaccctgcagcgccgag;

DPB1*4701:

(SEQ ID NO: 2072)

agaattaccttttccagggacggcaggaatgctacgcgtttaatgggacacagcgcttcctggagagatacatcta caaccgggaggagttcgtgcgcttcgacagcgacgtgggggagttccgggcggtgacggagctggggcggcctgaG gcggagtactggaacagccagaaggacatcctggaggagGagcgggcagtgccggacaggatgtgcagacacaact acgagctgggcgggcccAtgaccctgcagcgccgag;

DPB1*4801:

(SEQ ID NO: 2073)

aattaccttttccagggacggcaggaatgctacgcgtttaatgggacacagcgcttcctggagagatacatctaca accgggaggagCtcgtgcgcttcgacagcgacgtgggggagttccgggcggtgacggagctggggcggcctgatgA ggagtactggaacagccagaaggacatcctggaggaggagcgggcagtgccggacaggatgtgcagacacaactac gagctggGcgggcccAtgaccctgcag;

DPB1*4901:

(SEQ ID NO: 2074)

aattaccttttccagggacggcaggaatgctacgcgtttaatgggacacagcgcttcctggagagatacatctaca accgggaggagtacgcgcgcttcgacagcgacgtgggggagttccgggcggtgacggagctggggcggcctgatgA ggagtactggaacagccagaaggacatcctggaggagaagcgggcagtgccggacaggatGtgcagacacaactac gagctggGcgggcccatgaccctgcag;

DPB1*5001:

(SEQ ID NO: 2075)

aattacgtgtaccagggacggcaggaatgctacgcgtttaatgggacacagcgcttcctggagagatacatctaca accgggaggagttcgTgcgcttcgacagcgacgtgggggagttccgggcggtgacggagctggggcggcctgatga -continued ggaCtactggaacagccagaaggacCtcctggaggagaagcgggcagtgccggacagggtatgcagacacaactac gagctggacgaggccgtgaccctgcag;

DPB1*5101:

(SEQ ID NO: 2076)

agaattaccttttccagggacggcaggaatgctacgcgtttaatgggacacagcgcttcctggagagatacatcta caaccgggaggagtTcgcgcgcttcgacagcgacgtgggggagttccgggcggtgacggagctggggcggcctgat gAggagtactggaacagccagaaggacatcctggaggagaagcgggcagtgccggacaggatGtgcagacacaact acgagctggGcgggcccatgaccctgcagcgccgag;

DPB1*5201:

(SEQ ID NO: 2077)

agaattacgtgtaccagtTacggcaggaatgctacgcgtttaatgggacacagcgcttcctggagagatacatcta caaccgggaggagttcgTgcgcttcgacagcgacgtgggggagttccgggcggtgacggagctggggcggcctgct gcggagtactggaacagccagaaggacCtcctggaggagaagcgggcagtgccggacagggtatgcagacacaact acgagctggacgaggccgtgaccctgcag;

DPB1*5301:

(SEQ ID NO: 2078)

agaattaccttttccagggacggcaggaatgctacgcgtttaatgggacacagcgcttcctggagagatacatcta caaccgggaggagtacgcgcgcttcgacagcgacgtgggggagttccgggcggtgacggagctggggcggcctgat gAggagtactggaacagccagaaggacatcctggaggagaagcgggcagtgccggacaggatgtgcagacacaact acgagctggTcgggcccatgaccctgcag;

DPB1*5401:

(SEQ ID NO: 2079)

agaattacgtgcaccagtTacggcaggaatgctacgcgtttaatgggacacagcgcttcctggagagatacatcta caaccgggaggagttcgtgcgcttcgacagcgacgtgggggagttccgggcggtgacggagctggggcggcctgaG gcggagtactggaacagccagaaggacatcctggaggagGagcgggcagtgccggacagggtatgcagacacaact acgagctggacgaggccgtgaccctgcag;

DPB1*5501:

(SEQ ID NO: 2080)

agaattacgtgcaccagtTacggcaggaatgctacgcgtttaatgggacacagcgcttcctggagagatacatcta caaccgggaggagttcgTgcgcttcgacagcgacgtgggggagttccgggcggtgacggagctggggcggcctgct gcggagtactggaacagccagaaggacatcctggaggagGagcgggcagtgccggacaggatGtgcagacacaact acgagctggacgaggccgtgaccctgcag;

DPB1*5601:

(SEQ ID NO: 2081)

gtgtaccagttacggcaggaatgctacgcgtttaatgggacacagcgcttcctggagagatacatctacaaccggg aggagtTcgcgcgcttcgacagcgacgtgggggagttccgggcggtgacggagctggggcggcctgctgcggagta ctggaacagccagaaggacCtcctggaggagaagcgggcagtgccggacagggtatgcagacacaactacgagctg gacgaggccgtgaccctgcag;

DPB1*5701:

(SEQ ID NO: 2082)

cttttccagggacggcaggaatgctacgcgtttaatgggacacagcgcttcctggagagatacatctacaaccggg aggagttcgTgcgcttcgacagcgacgtgggggagttccgggcggtgacggagctggggcggcctgatgaggaCta ctggaacagccagaaggacCtcctggaggagaagcgggcagtgccggacagggtatgcagacacaactacgagctg gacgaggccg;

DPB1*5801:

(SEQ ID NO: 2083)

aattacgtgcaccagttacggcaggaatgctacgcgtttaatgggacacagcgcttcctggagagatacatctaca accgggaggagCtcgtgcgcttcgacagcgacgtgggggagttccgggcggtgacggagctggggcggcctgctgc -continued ggagtactggaacagccagaaggacatcctggaggagGagcgggcagtgccggacaggatGtgcagacacaactac gagctggacgaggccgtgaccctgcag;

DPB1*5901:
(SEQ ID NO: 2084)
agaattaccttttccagggacggcaggaatgctacgcgtttaatgggacacagcgcttcctggagagatacatcta caaccgggaggagttcgtgcgcttcgacagcgacgtgggggagttccgggcggtgacggagctggggcggcctgat gAggagtactggaacagccagaaggacCtcctggaggagaagcgggcagtgccggacaggatGtgcagacacaact acgagctggGcgggcccatgaccctgcag;

DPB1*6001:
(SEQ ID NO: 2085)
agaattaccttttccagggacggcaggaatgctacgcgtttaatgggacacagcgcttcctggagagatacatcta caaccgggaggagttcgtgcgcttcgacagcgacgtgggggagttccgggcggtgacggagctggggcggcctgat gaggagtactggaacagccagaaggacaAcctggaggagaagcgggcagtgccggacaggatgtgcagacacaact acgagctgggcgggcccatgaccctgcag;

DPB1*6101N:
(SEQ ID NO: 2086)
agaattacgtgtaccagttacggcaggaatgctacgcgtttaatgggacacagcgcttcctggagagatacatcta caaccgggaggagttcgtgcgcttcgacagcgacgtgggggagttccgggcggtgacggagctggggcggcctgat gaggactactggaacagccagaaggacctcctgTaggagaagcgggcagtgccggacagggtatgcagacacaact acgagctggacgaggccgtgaccctgcagcgc;

DPB1*6201:
(SEQ ID NO: 2087)
agaattaccttttccagggacggcaggaatgctacgcgtttaatgggacacagcgcttcctggagagatacatcta caaccgggaggagCtcgTgcgcttcgacagcgacgtgggggagttccgggcggtgacggagctggggcggcctgct gcggagtactggaacagccagaaggacatcctggaggagaagcgggcagtgccggacaggatgtgcagacacaact acgagctggTcgggcccatgaccctgcag;

DPB1*6301:
(SEQ ID NO: 2088)
aattaccttttccagggacggcaggaatgctacgcgtttaatgggacacagcgcttcctggagagatacatctaca accgggaggagCtcgtgcgcttcgacagcgacgtgggggagttccgggcggtgacggagctggggcggcctgctgc ggagtactggaacagccagaaggacatcctggaggagaagcgggcagtgccggacaggatGtgcagacacaactac gagctggacgaggccgtgaccctgcag;

DPB1*6401N:
(SEQ ID NO: 2089)
aattaagtgtaccagttacggcaggaatgctacgcgtttaatgggacacagcgcttcctggagagatacatctaca accgggaggagttcgtgcgcttcgacagcgacgtgggggagttccgggcggtgacggagctggggcggcctgatga ggaCtactggaacagccagaaggacCtcctggaggagGagcgggcagtgccggacaggatGtgcagacacaactac gagctggacgaggccgtgaccctgcag;

DPB1*6501:
(SEQ ID NO: 2090)
agaattaccttttccagggacggcaggaatgctacgcgtttaatgggacacagcgcttcctggagagatacatcta caaccgggaggagtacgcgcgcttcgacagcgacgtgggggagttccgggcggtgacggagctggggcggcctgct gcggagtactggaacagccagaaggacatcctggaggagaagcgggcagtgccggacagggtatgcagacacaact acgagctggacgaggccgtgaccctgcagcgccgag;

DPB1*6601:
(SEQ ID NO: 2091)
agaattacgtgtcaccagtTacggcaggaatgctacgcgtttaatgggacacagcgcttcctggagagatacatcta caaccgggaggagtTcgcgcgcttcgacagcgacgtgggggagttccgggcggtgacggagctggggcggcctgct gcggagtactggaacagccagaaggacatcctggaggagaagcgggcagtgccggacaggatGtgcagacacaact acgagctggGcgggcccatgaccctgcagcgccgag;

DPB1*6701:
(SEQ ID NO: 2092)
agaattacgtgcaccagtTacggcaggaatgctacgcgtttaatgggacacagcgcttcctggagagatacatcta caaccgggaggagttcgTgcgcttcgacagcgacgtgggggagttccgggcggtgacggagctggggcggcctgct gcggagtactggaacagccagaaggacCtcctggaggagaagcgggcagtgccggacagggtatgcagacacaact acgagctggacgaggccgtgaccctgcagcgccgag;

DPB1*6801:
(SEQ ID NO: 2093)
agaattaccttttccagggacggcaggaatgctacgcgtttaatgggacacagcgcttcctggagagatacatcta caaccgggaggagttcgTgcgcttcgacagcgacgtgggggagttccgggcggtgacggagctggggcggcctgat gAggagtactggaacagccagaaggacatcctggaggagaagcgggcagtgccggacagggtatgcagacacaact acgagctggacgaggccgtgaccctgcagcgccga;

DPB1*6901:
(SEQ ID NO: 2094)
agaattacgtgtaccagttacggcaggaatgctacgcgtttaatgggacacagcgcttcctggagagatacatcta caaccgggaggagttcgtgcgcttcgacagcgacgtgggggagttccgggcggtgacggagctggggcggcctgat gaggaCtactggaacagccagaaggacctcctggaggagaGgcgggcagtgccggacaggatgtgcagacacaact acgagctggacgaggccgtgacc;

DPB1*7001:
(SEQ ID NO: 2095)
aattacgtggaccagttacggcaggaatgctacgcgtttaatgggacacagcgcttcctggagagatacatctaca accgggaggagttcgTgcgcttcgacagcgacgtgggggagttccgggcggtgacggagctggggcggcctgatga ggaCtactggaacagccagaaggacCtcctggaggagaagcgggcagtgccggacagggtatgcagacacaactac gagctggacgaggccgtgaccctgcag;

DPB1*7101:
(SEQ ID NO: 2096)
aattaccttttccagggacggcaggaatgctacgcgtttaatgggacacagcgcttcctggagagatacatctaca accgggaggagttcgTgcgcttcgacagcgacgtgggggagttccgggcggtgacggagctggggcggcctgctgc ggagtactggaacagccagaaggacatcctggaggagGagcgggcagtgccggacaggatGtgcagacacaactac gagctggGcgggcccatgaccctgcag;

DPB1*7201:
(SEQ ID NO: 2097)
aattaccttttccagggacggcaggaatgctacgcgtttaatgggacacagcgcttcctggagagatacatctaca accgggaggagttcgcgcgcttcgacagcgacgtgggggagttccgggcggtgacggagctggggcggcctgctgc ggagtactggaacagccagaaggacCtcctggaggagaagcgggcagtgccggacaggatGtgcagacacaactac gagctggGcgggcccatgaccctgcag;

DPB1*7301:
(SEQ ID NO: 2098)
aattaccttttccagggacggcaggaatgctacgcgtttaatgggacacagcgcttcctggagagatacatctaca accgggaggagttcgtgcgcttcgacagcgacgtgggggagttccgggcggtgacggagctggggcggcctgatgA ggagtactggaacagccagaaggacCtcctggaggagaagcgggcagtgccggacagggtatgcagacacaactac gagctggGcgggcccatgaccctgcag;

DPB1*7401:
(SEQ ID NO: 2099)
gtgtaccagttacggcaggaatgctacgcgtttaatgggacacagcgcttcctggagagatacatctacaaccggC aggagtacgcgcgcttcgacagcgacgtgggagagttccgggcggtgacggagctggggcggcctgctgcggagta -continued ctggaacagccagaaggacctcctggaggagaggcgggcagtgccggacaggatgtgcagacacaactacgagctg gtcgggcccAtgaccctgcag;

DPB1*7501:
(SEQ ID NO: 2100)
cttttccagggacggcaggaatgctacgcgtttaatgggacacagcgcttcctggagagatacatctacaaccggg aggagttcgTgcgcttcgacagcgacgtgggggagttccgggcggtgacggagctggggcggcctgatgAggagta ctggaacagccagaaggacatcctggaggagaagcgggcagtgccggacagggtatgcagacacaactacgagctg gGcgggcccatgaccctgcag;

DPB1*7601:
(SEQ ID NO: 2101)
agaattacgtgcaccagtTacggcaggaatgctacgcgtttaatgggacacagcgcttcctggagagatacatcta caaccgggaggagttcgcgcgcttcgacagcgacgtgggggagttccgggcggtgacggagctggggcggcctgat gaggaCtactggaacagccagaaggacCtcctggaggagaagcgggcagtgccggacagggtatgcagacacaact acgagctggacgaggccgtgaccctgcag;

DPB1*7701:
(SEQ ID NO: 2102)
agaattaccttttccagggacTgcaggaatgctacgcgtttaatgggacacagcgcttcctggagagatacatcta caaccgggaggagttcgtgcgcttcgacagcgacgtgggggagttccgggcggtgacggagctggggcggcctgat gaggagtactggaacagccagaaggacatcctggaggagaagcgggcagtgccggacaggatgtgcagacacaact acgagctgggcgggcccatgaccctgcagcgccgag;

DPB1*7801:
(SEQ ID NO: 2103)
agaattacgtgtaccagttacggcaggaatgctacgcgtttaatgggacacagcgcttcctggagagatacatcta caaccgggaggagttcgtgcgcttcgacagcgacgtgggggagttccgggcggtgacggagctggggcggcctgat gaggactactggaacagccagaaggacctcctggaggagaagcgggcagtgcTggacagggtatgcagacacaact acgagctggacgaggccgtgaccctgcagcgccgag;

DPB1*7901:
(SEQ ID NO: 2104)
agaattacgtgtaccagtTacggcaggaatgctacgcgtttaatgggacacagcgcttcctggagagatacatcta caaccgggaggagttcgTgcgcttcgacagcgacgtgggggagttccgggcggtgacggagctggggcggcctgat gAggagtactggaacagccagaaggacatcctggaggagaagcgggcagtgccggacagggtatgcagacacaact acgagctggacgaggccgtgaccctgcagcgccgag;

DPB1*8001:
(SEQ ID NO: 2105)
agaattaccttttccagggacggcaggaatgctacgcgtttaatgggacacagcgcttcctggagagatacatcta caaccgggaggagttcgtgcgcttcgacagcgacgtgggggagttccgggcggtgacggagctggggcggcctgat gaggaCtactggaacagccagaaggacatcctggaggagaagcgggcagtgccggacaggatgtgcagacacaact acgagctgggcgggcccAtgacc;

DPB1*8101:
(SEQ ID NO: 2106)
agaattaccttttccagggacggcaggaatgctacgcgtttaatgggacacagcgcttcctggagagatacatcta caaccgggaggagttcgcgcgcttcgacagcgacgtgggggagttccgggcggtgacggagctggggcggcctgat gAggagtactggaacagccagaaggacatcctggaggagGagcgggcagtgccggacaggatGtgcagacacaact acgagctggGcgggcccatgaccctgcagcgccgag;

DPB1*8201:
(SEQ ID NO: 2107)
agaattaccttttccagggacggcaggaatgctacgcgtttaatgggacacagcgcttcctggagagatacatcta caaccgggaggagttcgtgcgcttcgacagcgacgtgggggagttccgggcggtgacggagctggggcggcctgat gaggagtactggaacagccagaaggacatcctggaggagaagcgggcagtgccggacaggatgtgcagacacaact acgagctgggcgggcccAtgaccctgcagcAccgag;

DPB1*8301:

(SEQ ID NO: 2108)
agaattaccttttccagggacggcaggaatgctacgcgtttaatgggacacagcgcttcctggagagatacatcta caaccgggaggagttcgtgcgcttcgacagcgacgtgggggagttccgggcggtgacggagctggggcggcctgat gaggagtactggaacagccagaaggacTtcctggaggagaagcgggcagtgccggacaggatgtgcagacacaact acgagctgggcgggcccatgaccctgcagcgccgag;

DPB1*8401:

(SEQ ID NO: 2109)
agaattaccttttccagggacggcaggaatgctacgcgtttaatgggacacagcgcttcctggagagatacatcta caaccgggaggagttcgtgcgcttcgacagcgacgtgggggagttccgggcggtgacggagctggggcggcctgaG gAggagtactggaacagccagaaggacatcctggaggagaagcgggcagtgccggacagggtatgcagacacaact acgagctggacgaggccgtgaccctgcagcgccga;

DPB1*8501:

(SEQ ID NO: 2110)
agaattacgtgtaccagtTacggcaggaatgctacgcgtttaatgggacacagcgcttcctggagagatacatcta caaccgggaggagtacgcgcgcttcgacagcgacgtgggggagttccgggcggtgacggagctggggcggcctgct gcggagtactggaacagccagaaggacatcctggaggagaagcgggcagtgccggacaggatgtgcagacacaact acgagctggacgaggccgtgaccctgcagcAccgag;

DPB1*8601:

(SEQ ID NO: 2111)
gaattacgtgcaccagtTacggcaggaatgctacgcgtttaatgggacacagcgcttcctggagagatacatctac aaccgggaggagttcgtgcgcttcgacagcgacgtgggggagttccgggcggtgacggagctggggcggcctgatg aggaCtactggaacagccagaaggacatcctggaggagGagcgggcagtgccggacaggatgtgcagacacaacta cgagctgggcgggcccAtgaccctgcagcgccga;

DPB1*8701:

(SEQ ID NO: 2112)
agaattacgtgtaccagtTacggcaggaatgctacgcgtttaatgggacacagcgcttcctggagagatacatcta caaccgggaggagttcgTgcgcttcgacagcgacgtgggggagttccgggcggtgacggagctggggcggcctgct gcggagtactggaacagccagaaggacCtcctggaggagaagcgggcagtgccggacaggatGtgcagacacaact acgagctggacgaggccgtgaccctgcagcgccgag;

DPB1*8801:

(SEQ ID NO: 2113)
agaattacgtgtaccagtTacggcaggaatgctacgcgtttaatgggacacagcgcttcctggagagatacatcta caaccgggaggagttcgtgcgcttcgacagcgacgtgggggagttccgggcggtgacggagctggggcggcctgat gaggaCtactggaacagccagaaggacatcctggaggagGagcgggcagtgccggacagggtatgcagacacaact acgagctggacgaggccgtgaccctgcagcgccgag;

DPB1*8901:

(SEQ ID NO: 2114)
agaattacgtgtaccagggacggcaggaatgctacgcgtttaatgggacacagcgcttcctggagagatacatcta caaccgggaggagtacgcgcgcttcgacagcgacgtgggggagttccgggcggtgacggagctggggcggcctgct gcggagtactggaacagccagaaggacatcctggaggagaagcgggcagtgccggacaggatGtgcagacacaact acgagctggacgaggccgtgaccctgcagcgccgag;

DPB1*9001:

(SEQ ID NO: 2115)
agaattacgtgtaccagggacggcaggaatgctacgcgtttaatgggacacagcgcttcctggagagatacatcta caaccgggaggagtTcgcgcgcttcgacagcgacgtgggggagttccgggcggtgacggagctggggcggcctgct -continued

```
gcggagtactggaacagccagaaggacatcctggaggagaagcgggcagtgccggacagggtatgcagacacaact acgagctggacgaggccgtgaccctgcagcgccgag;
```

DPB1*9101:
(SEQ ID NO: 2116)
```
agaattacgtgcaccagttacggcaggaatgctacgcgtttaatgggacacagcgcttcctggagagatacatcta caaccgggaggagttcgtgcgcttcgacagcgacgtgggggagttccgggcggtgacggagctggggcggcctgat gaggaCtactggaacagccagaaggacCtcctggaggagaagcgggcagtgccggacaggatGtgcagacacaact acgagctggacgaggccgtgaccctgcagcgccgag;
```

DPB1*9201:
(SEQ ID NO: 2117)
```
agaattacgtgtaccagtTacggcaggaatgctacgcgtttaatgggacacagcgcttcctggagagatacatcta caaccgggaggagttcgcgcgcttcgacagcgacgtgggggagttccgggcggtgacggagctggggcggcctgat gaggaCtactggaacagccagaaggacCtcctggaggagaagcgggcagtgccggacagggtatgcagacacaact acgagctggacgaggccgtgaccctgcagcgccgag;
```

DPB1*9301:
(SEQ ID NO: 2118)
```
agaattacgtgtaccagtTacggcaggaatgctacgcgtttaatgggacacagcgcttcctggagagatacatcta caaccgggaggagttcgTgcgcttcgacagcgacgtgggggagttccgggcggtgacggagctggggcggcctgat gAggagtactggaacagccagaaggacatcctggaggagGagcgggcagtgccggacaggatGtgcagacacaact acgagctggacgaggccgtgaccctgcagcgccgag;
```

DPB1*9601:
(SEQ ID NO: 2119)
```
agaattaccttttccagggacggcaggaatgctacgcgtttaatgggacacagcgcttcctggagagatacatcta caaccgggaggagtacgcgcgcttcgacagcgacgtgggggagttccgggcggtgacggagctggggcggcctgct gcggagtactggaacagccagaagCacatcctggaggagaagcgggcagtgccggacaggatgtgcagacacaact acgagctgggcgggcccatgaccctgcagcgccgag;
```

In the following, Probe lists DP1-DP4 are shown in Tables 13-1 to 13-3 and Tables 14-1 to 14-3 respectively. Probe-Allele Lists DP1-4 are shown in Tables 15-1 to 15-5 and Tables 16-1 to 16-5.

TABLE 13-1

| Probe No. | Base Sequence | |
|---|---|---|
| 0 | acg cat aga cca aca ggG | (SEQ ID No: 2120) |
| 1 | ag ttt atg ttt gaa ttt gat gaA | (SEQ ID No: 2121) |
| 2 | t ctg gag gag ttt ggc cA | (SEQ ID No: 2122) |
| 3 | g acg cat aga cca aca ggA | (SEQ ID No: 2123) |
| 4 | g ttt atg ttt gaa ttt gat gaC | (SEQ ID No: 2124) |
| 5 | cac act cag gcc gcc aaT | (SEQ ID No: 2125) |
| 6 | ttc tat gtg gat ctg gat aaA | (SEQ ID No: 2126) |
| 7 | ctg gag gag ttt ggc caa A | (SEQ ID No: 2127) |
| 8 | ctg gag gag ttt ggc cG | (SEQ ID No: 2128) |
| 9 | gcc gcg ttt gta cag acC | (SEQ ID No: 2129) |
| 10 | t gaa ttt gat gaa gat gag cA | (SEQ ID No: 2130) |
| 11 | ag ttc tat gtg gat ctg gaT | (SEQ ID No: 2131) |
| 12 | g acc cat aga cca aca ggA | (SEQ ID No: 2132) |

TABLE 13-1-continued

| Probe No. | Base Sequence | |
|---|---|---|
| 13 | t gcc atg ttt gta cag acC | (SEQ ID No: 2133) |
| 14 | at gtg tca act tat gcc aT | (SEQ ID NO: 2134) |
| 15 | ctg gct aac att gct ata tC | (SEQ ID No: 2135) |
| 16 | cat gtg tca act tat gcc aT | (SEQ ID No: 2136) |
| 17 | aac aac aac tta aat atc gct | (SEQ ID No: 2137) |

TABLE 13-2

| Probe No. | Base Sequence | |
|---|---|---|
| 0 | gca gtg ccg gac agg G | (SEQ ID No: 2138) |
| 1 | ca gtg ccg gac agg gtA | (SEQ ID No: 2139) |
| 2 | tc gac agc gac gtg ggA | (SEQ ID No: 2140) |
| 3 | c aac cgg gag gag ttc gT | (SEQ ID No: 2141) |
| 4 | ctg ggg cgg cct gat gA | (SEQ ID No: 2142) |
| 5 | g gac atc ctg gag gag G | (SEQ ID No: 2143) |
| 6 | ca gtg ccg gac agg atG | (SEQ ID No: 2144) |
| 7 | a cac aac tac gag ctg gG | (SEQ ID No: 2145) |
| 8 | g ctg ggg cgg cct gaC | (SEQ ID No: 2146) |
| 9 | ag gag gag cgg gca gtT | (SEQ ID No: 2147) |
| 10 | ga tac atc tac aac cgg gaA | (SEQ ID No: 2148) |
| 11 | c tac aac cgg gag gag ttT | (SEQ ID No: 2149) |
| 12 | c tac aac cgg gag gag C | (SEQ ID No: 2150) |
| 13 | g ctg ggg cgg cct gaG | (SEQ ID No: 2151) |
| 14 | gag ctg ggc ggg ccc A | (SEQ ID No: 2152) |
| 15 | ag aat tac gtg tac cag tT | (SEQ ID No: 2153) |
| 16 | gg cgg cct gat gag gaC | (SEQ ID No: 2154) |
| 17 | gg aac agc cag aag gac C | (SEQ ID No: 2155) |
| 18 | ac gag gcc gtg acc ctA | (SEQ ID No: 2156) |
| 19 | c tac aac cgg gag gag tT | (SEQ ID No: 2157) |
| 20 | aac cgg gag gag ctc gT | (SEQ ID No: 2158) |
| 21 | g gac ctc ctg gag gag G | (SEQ ID No: 2159) |
| 22 | ag aat tac gtg cac cag tT | (SEQ ID No: 2160) |
| 23 | aga tac atc tac aac cgg C | (SEQ ID No: 2161) |
| 24 | g gag aga tac atc tac aac A | (SEQ ID No: 2162) |
| 25 | g gca gtg ccg gac agg A | (SEQ ID No: 2163) |
| 26 | gag ctg gtc ggg ccc A | (SEQ ID No: 2164) |
| 27 | ga cac aac tac gag ctg gT | (SEQ ID No: 2165) |
| 28 | cc gtg acc ctg cag cgT | (SEQ ID No: 2166) |

TABLE 13-2-continued

| Probe No. | Base Sequence | |
|---|---|---|
| 29 | gg gca gtg ccg gac agA | (SEQ ID No: 2167) |
| 30 | g gag gag aag cgg gca T | (SEQ ID No: 2168) |

TABLE 13-3

| Probe No. | Base Sequence | |
|---|---|---|
| 31 | ggg cgg cct gat gag gT | (SEQ ID No: 2169) |
| 32 | ga cgg cag gaa tgc tac C | (SEQ ID No: 2170) |
| 33 | gg aac agc cag aag gac T | (SEQ ID No: 2171) |
| 34 | g gac ttc ctg gag gag G | (SEQ ID No: 2172) |
| 35 | gg aac agc cag aag gac aA | (SEQ ID No: 2173) |
| 36 | gc cag aag gac ctc ctg T | (SEQ ID No: 2174) |
| 37 | gac ctc ctg gag gag aG | (SEQ ID No: 2175) |
| 38 | aat tac ctt ttc cag gga cT | (SEQ ID No: 2176) |
| 39 | gag aag cgg gca gtg cT | (SEQ ID No: 2177) |
| 40 | ccc atg acc ctg cag cA | (SEQ ID No: 2178) |
| 41 | tg ggg cgg cct gag gA | (SEQ ID No: 2179) |
| 42 | gcc gtg acc ctg cag cA | (SEQ ID No: 2180) |
| 43 | g aat tac gtg cac cag tT | (SEQ ID No: 2181) |
| 44 | ac tgg aac agc cag aag C | (SEQ ID No: 2182) |

TABLE 14-1

| Probe No. | Base Sequence | |
|---|---|---|
| 0 | a cca aca ggG gag ttt atg | (SEQ ID No: 2183) |
| 1 | gaa ttt gat gaA gat gag atg | (SEQ ID No: 2184) |
| 2 | ag ttt ggc cAa gcc ttt tc | (SEQ ID No: 2185) |
| 3 | ga cca aca ggA gag ttt atg | (SEQ ID No: 2186) |
| 4 | gaa ttt gat gaC gat gag atg | (SEQ ID No: 2187) |
| 5 | at ctg gat aaA aag gag acc | (SEQ ID No: 2188) |
| 6 | ttt ggc caa Acc ttt tcc tt | (SEQ ID No: 2189) |
| 7 | ag ttt ggc cGa gcc ttt tc | (SEQ ID No: 2190) |
| 8 | t gta cag acC cat aga cca | (SEQ ID No: 2191) |
| 9 | gaa gat gag cAg ttc tat gt | (SEQ ID No: 2192) |
| 10 | cg ttt gta caA acc cat aga | (SEQ ID No: 2193) |
| 11 | g gat ctg gaT aag aag gag | (SEQ ID No: 2194) |
| 12 | act tat gcc aTg ttt gta cag | (SEQ ID No: 2195) |
| 13 | att gct ata tCg aac aac aac | (SEQ ID No: 2196) |
| 14 | g aat atc gcT atc cag cgt | (SEQ ID No: 2197) |

TABLE 14-2

| Probe No. | Base Sequence | |
|---|---|---|
| 0 | tAc cag gga cgg cag ga | (SEQ ID No: 2198) |
| 1 | ccg gac agg Gta tgc aga | (SEQ ID No: 2199) |
| 2 | g gac agg gtA tgc aga ca | (SEQ ID No: 2200) |
| 3 | gac gtg ggA gag ttc cg | (SEQ ID No: 2201) |
| 4 | at tac ctt tTc cag gga cg | (SEQ ID No: 2202) |
| 5 | g gag ttc gTg cgc ttc g | (SEQ ID No: 2203) |
| 6 | gg cct gat gAg gag tac t | (SEQ ID No: 2204) |
| 7 | g gag gag Gag cgg gca | (SEQ ID No: 2205) |
| 8 | g gac agg atG tgc aga ca | (SEQ ID No: 2206) |
| 9 | gag ctg gGc ggg ccc | (SEQ ID No: 2207) |
| 10 | cgg cct gaC gag gag ta | (SEQ ID No: 2208) |
| 11 | cgg gca gtT ccg gac ag | (SEQ ID No: 2209) |
| 12 | c aac cgg gaA gag ttc gt | (SEQ ID No: 2210) |
| 13 | g gag gag ttT gtg cgc tt | (SEQ ID No: 2211) |

TABLE 14-2-continued

| Probe No. | Base Sequence | |
|---|---|---|
| 14 | g gag gag Ctc gtg cgc | (SEQ ID No: 2212) |
| 15 | cgg cct gaG gcg gag t | (SEQ ID No: 2213) |
| 16 | c ggg ccc Atg acc ctg | (SEQ ID No: 2214) |
| 17 | tg tac cag tTa cgg cag g | (SEQ ID No: 2215) |
| 18 | t gat gag gaC tac tgg aac | (SEQ ID No: 2216) |
| 19 | cag aag gac Ctc ctg gag | (SEQ ID No: 2217) |
| 20 | gtg acc ctA cag cgc cg | (SEQ ID No: 2218) |
| 21 | g gag gag tTc gcg cgc | (SEQ ID No: 2219) |
| 22 | g gag ctc gTg cgc ttc g | (SEQ ID No: 2220) |
| 23 | aat tac gtg Cac cag tta cg | (SEQ ID No: 2221) |
| 24 | tac aac cgg Cag gag tac | (SEQ ID No: 2222) |
| 25 | atc tac aac Agg cag gag t | (SEQ ID No: 2223) |
| 26 | ccg gac agg Ata tgc aga | (SEQ ID No: 2224) |
| 27 | c gag ctg gTc ggg ccc | (SEQ ID No: 2225) |
| 28 | g ccg gac agA gta tgc ag | (SEQ ID No: 2226) |
| 29 | g cac cag tTa cgg cag g | (SEQ ID No: 2227) |
| 30 | g cgg gca Ttg ccg gac | (SEQ ID No: 2228) |

TABLE 14-3

| Probe No. | Base Sequence | |
|---|---|---|
| 31 | ct gat gag gTg tac tgg aa | (SEQ ID No: 2229) |
| 32 | gaa tgc tac Ccg ttt aat gg | (SEQ ID No: 2230) |
| 33 | cag aag gac Ttc ctg gag | (SEQ ID No: 2231) |
| 34 | ag aag gac aAc ctg gag g | (SEQ ID No: 2232) |
| 35 | gac ctc ctg Tag gag aag | (SEQ ID No: 2233) |
| 36 | g gag gag aGg cgg gca | (SEQ ID No: 2234) |
| 37 | g gac cag tTa cgg cag g | (SEQ ID No: 2235) |
| 38 | tc cag gga cTg cag gaa t | (SEQ ID No: 2236) |
| 39 | g gca gtg cTg gac agg g | (SEQ ID No: 2237) |
| 40 | g ctg ggc gGg ccc atg | (SEQ ID No: 2238) |
| 41 | cgg cct gaG gag gag ta | (SEQ ID No: 2239) |
| 42 | gg cct gag gAg gag tac t | (SEQ ID No: 2240) |
| 43 | agc cag aag Cac atc ctg | (SEQ ID No: 2241) |

TABLE 15-1

| Allele Number | Probe Number for Detection | | | |
|---|---|---|---|---|
| DPA1*010301 | 0 | 1 | 2 | |
| DPA1*010302 | 3 | | | |
| DPA1*0104 | 4 | | | |
| DPA1*0105 | 5 | | | |
| DPA1*0106 | 6 | | | |
| DPA1*0107 | 7 | | | |
| DPA1*0108 | 4 | 8 | | |
| DPA1*020101 | 9 | 6 | 5 | |
| DPA1*020102 | 6 | 5 | | |
| DPA1*020103 | 10 | 5 | | |
| DPA1*020104 | 6 | 5 | | |
| DPA1*020105 | 3 | 10 | 5 | |
| DPA1*020106 | 9 | 11 | 5 | |
| DPA1*020201 | 12 | 11 | 5 | |
| DPA1*020202 | 13 | 12 | 10 | 5 |
| DPA1*020203 | 14 | 5 | | |
| DPA1*0203 | 9 | 5 | | |
| DPA1*0301 | 15 | | | |
| DPA1*0302 | 16 | | | |
| DPA1*0401 | 17 | | | |

TABLE 15-2

| Allele Number | Probe Number for Detection | | | |
|---|---|---|---|---|
| DPB1*010101 | 0 | 1 | | |
| DPB1*010102 | 2 | | | |
| DPB1*020102 | 3 | 4 | 5 | 6 | 7 |
| DPB1*020103 | 8 | | | |
| DPB1*020104 | 9 | | | |
| DPB1*020105 | 10 | | | |
| DPB1*020106 | 11 | | | |
| DPB1*0202 | 12 | 13 | 5 | 14 |
| DPB1*030101 | 15 | 3 | 16 | 17 |
| DPB1*030102 | 18 | | | |
| DPB1*0401 | 19 | 6 | 7 | |
| DPB1*0402 | 3 | 4 | 6 | 7 |
| DPB1*0501 | 12 | 20 | 13 | 6 |
| DPB1*0601 | 16 | 17 | 21 | 6 |
| DPB1*0801 | 3 | 4 | 5 | |
| DPB1*0901 | 22 | 16 | 5 | |
| DPB1*1001 | 22 | 3 | 4 | 5 |
| DPB1*110101 | 23 | | | |
| DPB1*110102 | 24 | | | |
| DPB1*1301 | 15 | 5 | 25 | |
| DPB1*1401 | 22 | 3 | 16 | 17 |
| DPB1*1501 | 23 | 26 | | |
| DPB1*1601 | 3 | 4 | 5 | 6 |
| DPB1*1701 | 22 | 16 | 5 | 6 |
| DPB1*1801 | 3 | 4 | 27 | |
| DPB1*1901 | 13 | 5 | 25 | |
| DPB1*200101 | 16 | 17 | 6 | |
| DPB1*200102 | 28 | | | |
| DPB1*2101 | 15 | 12 | 13 | 5 | 6 |
| DPB1*2201 | 12 | 13 | 5 | 6 |

TABLE 15-3

| Allele Number | Probe Number for Detection | | | |
|---|---|---|---|---|
| DPB1*2301 | 3 | 6 | 7 | |
| DPB1*2401 | 13 | 14 | | |
| DPB1*2501 | 15 | 3 | 4 | 17 |
| DPB1*260101 | 29 | | | |
| DPB1*2701 | 15 | 6 | | |
| DPB1*2801 | 4 | 17 | 27 | |
| DPB1*2901 | 16 | 17 | 21 | |
| DPB1*3001 | 22 | 13 | 5 | 6 |
| DPB1*3101 | 30 | | | |
| DPB1*3201 | 31 | | | |
| DPB1*3301 | 5 | 6 | 7 | |
| DPB1*3401 | 30 | 26 | | |
| DPB1*3501 | 22 | 3 | 16 | |
| DPB1*3601 | 15 | 12 | 20 | 13 | 6 |
| DPB1*3701 | 3 | 4 | 5 | |
| DPB1*3801 | 32 | | | |

TABLE 15-3-continued

| Allele Number | Probe Number for Detection | | | |
|---|---|---|---|---|
| DPB1*3901 | 6 | 7 | | |
| DPB1*4001 | 27 | | | |
| DPB1*4101 | 33 | 34 | | |
| DPB1*4401 | 12 | 17 | 21 | |
| DPB1*4501 | 3 | 4 | 17 | |
| DPB1*4601 | 16 | 5 | 14 | |
| DPB1*4701 | 13 | 5 | 14 | |
| DPB1*4801 | 12 | 4 | 7 | 14 |
| DPB1*4901 | 4 | 6 | 7 | |
| DPB1*5001 | 3 | 16 | 17 | |
| DPB1*5101 | 19 | 4 | 6 | 7 |
| DPB1*5201 | 15 | 3 | 17 | |
| DPB1*5301 | 4 | 27 | | |
| DPB1*5401 | 22 | 13 | 5 | |

TABLE 15-4

| Allele Number | Probe Number for Detection | | | |
|---|---|---|---|---|
| DPB1*5501 | 22 | 3 | 5 | 6 |
| DPB1*5601 | 19 | 17 | | |
| DPB1*5701 | 3 | 16 | 17 | |
| DPB1*5801 | 12 | 5 | 6 | |
| DPB1*5901 | 4 | 17 | 6 | 7 |
| DPB1*6001 | 35 | | | |
| DPB1*6101N | 36 | | | |
| DPB1*6201 | 12 | 20 | 27 | |
| DPB1*6301 | 12 | 6 | | |
| DPB1*6401N | 16 | 17 | 21 | 6 |
| DPB1*6601 | 22 | 19 | 6 | 7 |
| DPB1*6701 | 22 | 3 | 17 | |
| DPB1*6801 | 3 | 4 | | |
| DPB1*6901 | 16 | 37 | | |
| DPB1*7001 | 3 | 16 | 17 | |
| DPB1*7101 | 3 | 5 | 6 | 7 |
| DPB1*7201 | 17 | 6 | 7 | |
| DPB1*7301 | 4 | 17 | 7 | |
| DPB1*7401 | 23 | 26 | | |
| DPB1*7501 | 3 | 4 | 7 | |
| DPB1*7601 | 22 | 16 | 17 | |
| DPB1*7701 | 38 | | | |
| DPB1*7801 | 39 | | | |
| DPB1*7901 | 15 | 3 | 4 | |
| DPB1*8001 | 16 | 14 | | |
| DPB1*8101 | 4 | 5 | 6 | 7 |
| DPB1*8201 | 14 | 40 | | |
| DPB1*8301 | 33 | | | |
| DPB1*8401 | 13 | 41 | | |
| DPB1*8501 | 15 | 42 | | |

TABLE 15-5

| Allele Number | Probe Number for Detection | | | |
|---|---|---|---|---|
| DPB1*8601 | 43 | 16 | 5 | 14 |
| DPB1*8701 | 15 | 3 | 17 | 6 |
| DPB1*8801 | 15 | 16 | 5 | |
| DPB1*8901 | 6 | | | |
| DPB1*9001 | 19 | | | |
| DPB1*9101 | 16 | 17 | 6 | |
| DPB1*9201 | 15 | 16 | 17 | |
| DPB1*9301 | 15 | 3 | 4 | 5 | 6 |
| DPB1*9601 | 44 | | | |

TABLE 16-1

| Allele Number | Probe Number for Detection | | |
|---|---|---|---|
| DPA1*010301 | 0 | 1 | 2 |
| DPA1*010302 | 3 | | |
| DPA1*0104 | 4 | | |

TABLE 16-1-continued

| Allele Number | Probe Number for Detection | | | |
|---|---|---|---|---|
| DPA1*0106 | 5 | | | |
| DPA1*0107 | 6 | | | |
| DPA1*0108 | 4 | 7 | | |
| DPA1*020101 | 8 | 5 | 7 | |
| DPA1*020102 | 5 | 7 | | |
| DPA1*020103 | 9 | 7 | | |
| DPA1*020104 | 10 | | | |
| DPA1*020105 | 3 | 9 | 7 | |
| DPA1*020106 | 8 | 11 | 7 | |
| DPA1*020201 | 3 | 11 | 7 | |
| DPA1*020202 | 8 | 3 | 9 | 7 |
| DPA1*020203 | 12 | 7 | | |
| DPA1*0203 | 8 | 7 | | |
| DPA1*0301 | 13 | | | |
| DPA1*0302 | 12 | | | |
| DPA1*0401 | 14 | | | |

TABLE 16-2

| Allele Number | Probe Number for Detection | | | | |
|---|---|---|---|---|---|
| DPB1*010101 | 0 | 1 | 2 | | |
| DPB1*010102 | 3 | | | | |
| DPB1*020102 | 4 | 5 | 6 | 7 | 8 | 9 |
| DPB1*020103 | 10 | | | | |
| DPB1*020104 | 11 | | | | |
| DPB1*020105 | 12 | | | | |
| DPB1*020106 | 13 | | | | |
| DPB1*0202 | 14 | 15 | 7 | 16 | |
| DPB1*030101 | 17 | 5 | 18 | 19 | |
| DPB1*030102 | 20 | | | | |
| DPB1*0401 | 4 | 21 | 8 | 9 | |
| DPB1*0402 | 4 | 5 | 6 | 8 | 9 |
| DPB1*0501 | 4 | 14 | 22 | 15 | 8 |
| DPB1*0601 | 18 | 19 | 7 | 8 | |
| DPB1*0801 | 5 | 6 | 7 | | |
| DPB1*0901 | 23 | 18 | 7 | | |
| DPB1*1001 | 23 | 6 | 7 | | |
| DPB1*110101 | 17 | 24 | | | |
| DPB1*110102 | 25 | | | | |
| DPB1*1301 | 17 | 7 | 26 | | |
| DPB1*1401 | 23 | 5 | 18 | 19 | |
| DPB1*1501 | 24 | 16 | | | |
| DPB1*1601 | 4 | 5 | 6 | 7 | 8 |
| DPB1*1701 | 23 | 18 | 7 | 8 | |
| DPB1*1801 | 5 | 6 | 27 | | |
| DPB1*1901 | 4 | 15 | 7 | 26 | |
| DPB1*200101 | 18 | 19 | 8 | | |
| DPB1*200102 | 18 | 19 | 8 | | |

TABLE 16-3

| Allele Number | Probe Number for Detection | | | | |
|---|---|---|---|---|---|
| DPB1*2101 | 17 | 14 | 15 | 7 | 8 |
| DPB1*2201 | 4 | 14 | 15 | 7 | 8 |
| DPB1*2301 | 4 | 5 | 8 | 9 | |
| DPB1*2401 | 15 | 16 | | | |
| DPB1*2501 | 17 | 5 | 6 | 19 | |
| DPB1*260101 | 28 | | | | |
| DPB1*260102 | 17 | | | | |
| DPB1*2701 | 17 | 8 | | | |
| DPB1*2801 | 6 | 19 | 27 | | |
| DPB1*2901 | 18 | 19 | 7 | | |
| DPB1*3001 | 23 | 29 | 15 | 7 | 8 |
| DPB1*3101 | 30 | | | | |
| DPB1*3201 | 31 | | | | |
| DPB1*3301 | 4 | 7 | 8 | 9 | |
| DPB1*3401 | 30 | 16 | | | |
| DPB1*3501 | 23 | 5 | 18 | | |
| DPB1*3601 | 17 | 14 | 22 | 15 | 8 |
| DPB1*3701 | 17 | 5 | 6 | 7 | |
| DPB1*3801 | 32 | | | | |

TABLE 16-3-continued

| Allele Number | Probe Number for Detection | | | |
|---|---|---|---|---|
| DPB1*3901 | 4 | 8 | 9 | |
| DPB1*4001 | 4 | 27 | | |
| DPB1*4101 | 33 | 7 | | |
| DPB1*4401 | 14 | 19 | 7 | |
| DPB1*4501 | 29 | 5 | 6 | 19 |
| DPB1*4601 | 4 | 18 | 7 | 16 |
| DPB1*4701 | 15 | 7 | 16 | |
| DPB1*4801 | 14 | 6 | 9 | 16 |
| DPB1*4901 | 6 | 8 | 9 | |
| DPB1*5001 | 5 | 18 | 19 | |
| DPB1*5101 | 4 | 21 | 6 | 8 | 9 |

TABLE 16-4

| Allele Number | Probe Number for Detection | | | |
|---|---|---|---|---|
| DPB1*5201 | 17 | 5 | 19 | |
| DPB1*5301 | 4 | 6 | 27 | |
| DPB1*5401 | 23 | 29 | 15 | 7 |
| DPB1*5501 | 23 | 7 | 8 | |
| DPB1*5601 | 17 | 21 | 19 | |
| DPB1*5701 | 5 | 18 | 19 | |
| DPB1*5801 | 29 | 14 | 7 | 8 |
| DPB1*5901 | 6 | 19 | 8 | 9 |
| DPB1*6001 | 34 | | | |
| DPB1*6101N | 35 | | | |
| DPB1*6201 | 14 | 22 | 27 | |
| DPB1*6301 | 14 | 8 | | |
| DPB1*6401N | 18 | 19 | 7 | 8 |
| DPB1*6501 | 4 | | | |
| DPB1*6601 | 23 | 16 | | |
| DPB1*6701 | 23 | 5 | 19 | |
| DPB1*6801 | 4 | 5 | 6 | |
| DPB1*6901 | 18 | 36 | | |
| DPB1*7001 | 37 | 5 | 18 | 19 |
| DPB1*7101 | 5 | 7 | 8 | 9 |
| DPB1*7201 | 19 | 8 | 9 | |
| DPB1*7301 | 6 | 19 | 9 | |
| DPB1*7401 | 17 | 24 | 16 | |
| DPB1*7501 | 5 | 6 | 9 | |
| DPB1*7601 | 23 | 18 | 19 | |
| DPB1*7701 | 38 | | | |
| DPB1*7801 | 39 | | | |
| DPB1*7901 | 17 | 5 | 6 | |
| DPB1*8001 | 4 | 18 | 40 | |
| DPB1*8101 | 4 | 6 | 7 | 8 | 9 |

TABLE 16-5

| Allele Number | Probe Number for Detection | | | | |
|---|---|---|---|---|---|
| DPB1*8201 | 4 | 5 | 6 | 8 | 9 |
| DPB1*8301 | 33 | | | | |
| DPB1*8401 | 41 | 42 | | | |
| DPB1*8501 | 17 | 8 | | | |
| DPB1*8601 | 23 | 7 | 16 | | |
| DPB1*8701 | 17 | 5 | 19 | 8 | |
| DPB1*8801 | 17 | 18 | 7 | | |
| DPB1*8901 | 8 | | | | |
| DPB1*9001 | 21 | | | | |
| DPB1*9101 | 23 | 19 | 8 | | |
| DPB1*9201 | 17 | 18 | 19 | | |
| DPB1*9301 | 17 | 5 | 6 | 7 | 8 |
| DPB1*9601 | 43 | | | | |

Example 9

Probes for identification of HLA-DQ allele Extraction of DNA from 1 ml of human blood was performed using GFX Genomic Blood DNA Purification Kit from Amersham Biosciences in the same manner as in Example 1.

Next, quantitative PCR was carried out in the same manner as in Example 1 except that probes in the probe lists DQ1A and DQ1B were used and 2 μl of the mixed primers consisting of 1 μl each of respective solutions of the following primers (10 pmol/μl) and 6 μl of ultra pure water were used:

```
GGTGAGGTAACTGATCTTG           (SEQ ID NO: 2413)

TCCTTCTGGCTGTTCCAGTACTC.      (SEQ ID NO: 2414)
```

After PCR amplification, referring to Amp Plot and Dissociation curves on a display of 5700 software, and to the allele-probe list (Table 19A, 19B-1 and 19B-2), it was identified as DQA1*0103 and DQB1*060101.

Example 10

Extraction of DNA from 1 ml of human blood was performed in the same way as in Example 3. PCR of human HLA-DQ was then performed in the same manner as in Example 2 except that 3 μl of the mixed primer consisting of 1 μl each of the solutions containing the following sequences at 10 pmol/μl respectively, and 12 μl of ultra pure water were used:

```
GGTGAGGTAACTGATCTTG           (SEQ ID NO: 2413)

ATGATCCTAAACAAAGCTCTG         (SEQ ID NO: 2415)

TGTGCTACTTCACCAACGGGACG.      (SEQ ID NO: 2416)
```

At the same time, a DNA microarray was prepared to identify the allele in the specimen described above in the same manner as in Example 2, except that probes in the probe list of Tables 18A, 18B-1 and 18B-2 were used to form the probe spots respectively.

Then, hybridization was performed using the above specimen and the prepared DNA microarray in the same manner as in Example 2. Fluorometry measurement was conducted with GenePix4000B (Axon). Referring to the allele-probe list (Tables 20A, 20B-1 and 20B-2), it was identified as DQA1*0103 and DQB1*060101.

```
Allele list
DQA1*010101
                                              (SEQ ID NO: 2417)
atgatcctaaacaaagctctgctgctgggggccctcgctctgaccaccgtgatgagcccctgtggaggtgaagaca ttgtggctgaccacgttgcctcttgtggtgtaaacttgtaccagttttacggtccctctggccagtacacccatga atttgatggagatgagGagttctacgtggacctggagaggaaggagactgcctggcggtggcctgagttcagcaaa tttggaggttttgacccgcagggtgcactgagaaacatggctgtggcaaaacacaacttgaacatcatgattaaac
```

```
gctacaactctaccgctgctaccaatgaggttcctgaggtcacagtgttttccaagtctcccgtgacactgggtca gcccaacaccctcatttgtcttgtggacaacatcttcctcctgtggtcaacatcacatggctgagcaatgggcag tcagtcacagaaggtgtttctgagaccagcttcctctccaagagtgatcattccttcttcaagatcagttacctca ccttcctcccttctgctgatgagatttatgactgcaaggtggagcactggggcctggaccagcctcttctgaaaca ctgggagcctgagattccagcccctatgtcagagctcacagagactgtggtctgcgccctggggttgtctgtgggc ctcgtgggcattgtggtgggcactgtcttcatcatccaaggcctgcgttcagttggtgcttccagacaccaagggc cattgtga
```

DQA1*010102 (SEQ ID NO: 2418)

```
atgatcctaaacaaagctctgctgctgggggccctcgctctgaccaccgtgatgagccctgtggaggtgaagaca ttgtggctgaccacgttgcctcttgtggtgtaaacttgtaccagttttacggtccctctggccagtacacccatga atttgatggagatgaggagttctacgtggacctggagaggaaggagactgcctggcggtggcctgagttcagcaaa tttggaggttttgacccgcagggtgcactgagaaacatggctgtggcaaaacacaacttgaacatcatgattaaac gctacaactctaccgctgctaccaatgaggttcctgaggtcacagtgttttccaagtctcccgtgacactgggtca gcccaacaccctcatttgtcttgtggacaacatctttcctcctgtggtcaacatcacatggctgagcaatgggcag tcagtcacagaaggtgtttctgagaccagcttcctctccaagagtgatcattccttcttcaagatcagttacctca ccttcctcccttctgctgatgagatttatgactgcaaggtggagcactggggcctggaccagcctcttctgaaaca ctgggagcctgagattccagcccctatgtcagagctcacagagactgtggtctgcgccctggggttgtctgtgggc ctcgtgggcattgtggtgggcactgtcttcatcatccaaggcctgcgttcagttggtgcttccagacaccaGgggc cattgtga
```

DQA1*010201 (SEQ ID NO: 2419)

```
atgatcctaaacaaagctctgctgctgggggccctcgctctgaccaccgtgatgagccctgtggaggtgaagaca ttgtggctgaccacgttgcctcttgtggtgtaaacttgtaccagttttacggtccctctggccagtacacccatga atttgatggagatgagcagttctacgtggacctggagaggaaggagactgcctggcggtggcctgagttcagcaaa tttggaggttttgacccgcagggtgcactgagaaacatggctgtggcaaaacacaacttgaacatcatgattaaac gctacaactctaccgctgctaccaatgaggttcctgaggtcacagtgttttccaagtctcccgtgacactgggtca gcccaacaccctcatttgtcttgtggacaacatctttcctcctgtggtcaacatcacatggctgagcaatgggcag tcagtcacagaaggtgtttctgagaccagcttcctctccaagagtgatcattccttcttcaagatcagttacctca ccttcctcccttctgctgatgagatttatgactgcaaggtggagcactggggcctggaccagcctcttctgaaaca ctgggagcctgagattccagcccctatgtcagagctcacagagactgtggtctgtgccctggggttgtctgtgggc ctcAtgggcattgtggtgggcactgtcttcatcatccaaggcctgcgttcagttggtgcttccagacaccaagggc cattgtga
```

DQA1*010202 (SEQ ID NO: 2420)

```
atgatcctaaacaaagctctgctgctgggggccctcgctctgaccaccgtgatgagccctgtggaggtgaagaca ttgtggctgaccacgttgcctcttgtggtgtaaacttgtaccagttttacggtccctctggccagtacacccatga atttgatggagatgagcagttctacgtggacctggagaggaaggagactgcctggcggtggcctgagttcagcaaa tttggaggttttgacccgcagggtgcactgagaaacatggctgtggcaaaacacaacttgaacatcatgattaaac gctacaactctaccgctgctaccaatgaggttcctgaggtcacagtgttttccaagtctcccgtgacactgggtca gcccaacaccctcatCtgtcttgtggacaacatctttcctcctgtggtcaacatcacatggctgagcaatgggcag tcagtcacagaaggtgtttctgagaccagcttcctctccaagagtgatcattccttcttcaagatcagttacctca ccttcctcccttctgctgatgagatttatgactgcaaggtggagcactggggcctggaccagcctcttctgaaaca ctgggagcctgagattccagcccctatgtcagagctcacagagactgtggtctgtgccctggggttgtctgtgggc
```

-continued ctcAtgggcattgtggtgggcactgtcttcatcatccaaggcctgcgttcagttggtgcttccagacaccaagggc
cattgtga DQA1*0103 (SEQ ID NO: 2421)
atgatcctaaacaaagctctgctgctgggggccctcgctctgaccaccgtgatgagccctgtggaggtgaagaca
ttgtggctgaccatgttgcctcttgtggtgtaaacttgtaccagttttacggtccctctggccagttcacccatga
atttgatggagatgagcagttctacgtggacctggagaagaaggagactgcctggcggtggcctgagttcagcaaa
tttggaggttttgacccgcagggtgcactgagaaacatggctgtggcaaaacacaacttgaacatcatgattaaac
gctacaactctaccgctgctaccaatgaggttcctgaggtcacagtgttttccaagtctcccgtgacactgggtca
gcccaacaccctcatctgtcttgtggacaacatctttcctcctgtggtcaacatcacatggctgagcaatgggcac
Gcagtcacagaaggtgtttctgagaccagcttcctctccaagagtgatcattccttcttcaagatcagttacctca
ccttcctcccttctgctgatgagatttatgactgcaaggtggagcactggggcctggaccagcctcttctgaaaca
ctgggagcctgagattccagcccctatgtcagagctcacagagactgtggtctgtgccctggggttgtctgtgggc
ctcgtgggcattgtggtgggcactgtcttcatcatccaaggcctgcgttcagttggtgcttccagacaccaagggc
ccttgtga DQA1*010401 (SEQ ID NO: 2422)
atgatcctaaacaaagctctgctgctgggggccctcgctctgaccaccatgatgagccctgtggaggtgaaggca
ttgtggctgaccacgttgcctcttgtggtgtaaacttgtaccagttttacggtccctctggccagtacacccatga
atttgatggagatgaggagttctacgtggacctggagaggaaggagactgcctggcggtggcctgagttcagcaaa
tttggaggttttgacccgcagggtgcactgagaaacatggctgtggcaaaacacaacttgaacatcatgattaaac
gctacaactctaccgctgctaccaatgaggttcctgaggtcacagtgttttccaagtctcccgtgacactgggtca
gcccaacaccctcatttgtcttgtggacaacatctttcctcctgtggtcaacatcacatggctgagcaatgggcag
tcagtcacagaaggtgtttctgagaccagcttcctctccaagagtgatcattccttcttcaagatcagttacctca
ccttcctcccttctgctgatgagatttatgactgcaaggtggagcactggggcctggaccagcctcttctgaaaca
ctgggagcctgagattccagcccctatgtcagagctcacagagactgtggtctgcAccctggggttgtctgtgggc
ctcgtgggcattgtggtgggcactgtcttcatcatccaaggcctgcgttcagttggtgcttccagacaccaagggc
cattgtga DQA1*010402 (SEQ ID NO: 2423)
atgatcctaaacaaagctctgctgctgggggccctcgctctgaccaccatgatgagccctgtggaggtgaagGca
ttgtggctgaccacgttgcctcttgtggtgtaaacttgtaccagttttacggtccctctggccagtacacccatga
atttgatggagatgaggagttctacgtggacctggagaggaaggagactgcctggcggtggcctgagttcagcaaa
tttggaggttttgacccgcagggtgcactgagaaacatggctgtggcaaaacacaacttgaacatcatgattaaac
gctacaactctaccgctgctaccaatgaggttcctgaggtcacagtgttttccaagtctcccgtgacactgggtca
gcccaacaccctcatttgtcttgtggacaacatctttcctcctgtggtcaacatcacCtggctgagcaatgggcag
tcagtcacagaaggtgtttctgagaccagcttcctctccaagagtgatcattccttcttcaagatcagttacctca
ccttcctcccttctgctgatgagatttatgactgcaaggtggagcactggggcctggaccagcctcttctgaaaca
ctggg DQA1*0105 (SEQ ID NO: 2424)
atgatcctaaacaaagctctgctgctgggggccctcgctctgaccaccatgatgagccctgtggaggtgaagGca
ttgtggctgaccacgttgcctcttgtggtgtaaacttgtaccagttttacggtccctctggccagtacacccatga
atttgatggagatgaggagttctacgtggacctggagaggaaggagactgcctggcggtggcctgagttcagcaaa -continued tttggaggttttgacccgcagggtgcactgagaaacatggctgtggcaaaacacaacttgaacatcatgattaaac
gctacaactctaccgctgctaccaatgaggttcctgaggtcacagtgttttccaagtctcccgtgacactgggtca
gcccaacaccctcatttgtcttgtggacaacatctttcctcctgtggtcaacatcacatggctgagcaatgggcag
tcagtcacagaaggtgtttctgagaccagcttcctctccaagagtgatcattccttcttcaagatcagttacctca
ccttcctcccttctgctgatgagatttatgactgcaaggtggagcactggggcctggaccagcctcttctgaaaca
ctgggagcctgagattccagcccctatgtcagagctcacagagactgtggtctgcgccctggggttgtctgtgggc
ctcgtgggcattgtggtgggcactgtcttcatcatccaaggcctgcgttcagttggtgcttccaga DQA1*0106 (SEQ ID NO: 2425)
ctgaccacgttgcctcttgtggtgtaaacttgtaccagttttacggtccctctggccagtacacccatgaatttga
tggagatgagcagttctacgtggacctggagaggaaggagGctgcctggcggtggcctgagttcagcaaatttgga
ggttttgacccgcagggtgcactgagaaacatggctgtggcaaaacacaacttgaacatcatgattaaacgctaca
actctaccgctgctaccaatg DQA1*0201 (SEQ ID NO: 2426)
atgatcctaaacaaagctctgatgctgggggccctcgccctgaccaccgtgatgagcccttgtggaggtgaagaca
ttgtggctgaccacgttgcctcttacggtgtaaacttgtaccagtcttacggtccctctggccagttcacccatga
atttgatggagacgaggagttctatgtggacctggagaggaaggagactgtctggaagttgcctctgttccacaga
Cttaga...tttgacccgcaatttgcactgacaaacatcgctgtgctaaaacataacttgaacatcctgattaaac
gctccaactctaccgctgctaccaatgaggttcctgaggtcacagtgttttccaagtctcccgtgacactgggtca
gcccaacaccctcatctgtcttgtggacaacatctttcctcctgtggtcaacatcacctggctgagcaatgggcac
tcagtcacagaaggtgtttctgagaccagcttcctctccaagagtgatcattccttcttcaagatcagttacctca
ccttcctcccttctgctgatgagatttatgactgcaaggtggagcactggggcctggatgagcctcttctgaaaca
ctgggagcctgagattccagcacctatgtcagagctcacagagactgtggtctgtgccctgggggttgtctgtgggc
ctcgtgggcattgtggtggggaccgtcttgatcatccgaggcctgcgttcagttggtgcttccagacaccaagggc
ccttgtga DQA1*030101 (SEQ ID NO: 2427)
atgatcctaaacaaagctctgatgctgggggccctcgccctgaccaccgtgatgagcccttgtggaggtgaagaca
ttgtggctgaccatgttgcctcttacggtgtaaacttgtaccagtcttatggtccctctgggcagtacagccatga
atttgatggagacgaggagttctatgtggacctggagaggaaggagactgtctggcagttgcctctgttccgcaga
tttagaagatttgacccgcaatttgcactgacaaacatcgctgtgctaaaacataacttgaacatcgtgattaaac
gctccaactctaccgctgctaccaatgaggttcctgaggtcacagtgttttccaagtctcccgtgacactgggtca
gcccaacaccctcatctgtcttgtggacaacatctttcctcctgtggtcaacatcacctggctgagcaatgggcac
tcagtcacagaaggtgtttctgagaccagcttcctctccaagagtgatcattccttcttcaagatcagttacctca
ccttcctcccttctgctgatgagatttatgactgcaaggtggagcactggggcctggatgagcctcttctgaaaca
ctgggagcctgagattccaAcacctatgtcagagctcacagagactgtggtctgcgccctgggggttgtctgtgggc
ctcgtgggcattgtggtggggaccgtcttgatcatccgaggcctgcgttcagttggtgcttccagacaccaagggc
ccttgtga DQA1*0302 (SEQ ID NO: 2428)
atgatcctaaacaaagctctgatgctgggggccctcgccctgaccaccgtgaCgagcccttgtggaggtgaagaca
ttgtggctgaccatgttgcctcttacggtgtaaacttgtaccagtcttatggtccctctgggcagtacagccatga
atttgatggagacgaggagttctatgtggacctggagaggaaggagactgtctggcagttgcctctgttccgcaga
tttagaagatttgacccgcaatttgcactgacaaacatcgctgtgctaaaacataacttgaacatcgtgattaaac -continued gctccaactctaccgctgctaccaatgaggttcctgaggtcacagtgttttccaagtctcccgtgacactgggtca gcccaacaccctcatctgtcttgtggacaacatcttcctcctgtggtcaacatcacctggctgagcaatgggcac tcagtcacagaaggtgtttctgagaccagcttcctctccaagagtgatcattccttcttcaagatcagttacctca ccttcctcccttctgatgatgagatttatgactgcaaggtggagcactggggcctggatgagcctcttctgaaaca ctgggagcctgagattccaacacctatgtcagagctcacagagactgtggtctgcgccctggggttgtctgtgggc ctcgtgggcattgtggtggggaccgtcttgatcatccgaggcctgcgttcagttggtgcttccagacaccaagggc ccttgtga

DQA1*0303 (SEQ ID NO: 2429)

atgatcctaaacaaagctctgatgctggggggccctcgccctgaccaccgtgatgagcccttgtggaggtgaagaca ttgtggctgaccatgttgcctcttacggtgtaaacttgtaccagtcttatggtccctctgggcagtacagccatga atttgatggagacgaggagttctatgtggacctggagaggaaggagactgtctggcagttgcctctgttccgcaga tttagaagatttgacccgcaatttgcactgacaaacatcgctgtgctaaaacataacttgaacatcgtgattaaac gctccaactctaccgctgctaccaatgaggttcctgaggtcacagtgttttccaagtctcccgtgacactgggtca gcccaacaccctcatctgtcttgtggacaacatcttcctcctgtggtcaacatcacctggctgagcaatgggcac tcagtcacagaaggtgtttctgagaccagcttcctctccaagagtgatcattccttcttcaagatcagttacctca ccttcctcccttctgAtgatgagatttatgactgcaaggtggagcactggggcctggatgagcctcttctgaaaca ctgggagcctgagattccaacacctatgtcagagctcacagagactgtggtctgcgccctggggttgtctgtgggc ctcgtgggcattgtggtggggaccgtcttgatcatccgaggcctgcgttcagttggtgcttccagacaccaagggc ccttgtga

DQA1*040101 (SEQ ID NO: 2430)

atgatcctaaacaaagctctgctgctggggggcccttgccctgaccaccgtgatgagcccctgtggaggtgaagaca ttgtggctgaccatgttgcctcttatggtgtaaacttgtaccagtcttacggtccctctggccagtacacccatga atttgatggagacgagcagttctacgtggacctggggaggaaggagactgtctggtgtttgcctgttctcagacaa tttaga...tttgacccgcaatttgcactgacaaacatcgctgtgacaaaacacaacttgaacatcctgattaaac gctccaactctacTgctgctaccaatgaggttcctgaggtcacagtgttttccaagtctcccgtgacgctgggtca gcccaacaccctcatctgtcttgtggacaacatcttcctcctgtggtcaacatcacatggctgagcaatgggcac tcagtcacagaaggtgtttctgagaccagcttcctctccaagagtgatcattccttcttcaagatcagttacctca ccttcctcccttctgctgatgagatttatgactgcaaggtggagcactggggcctggacgagcctcttctgaaaca ctgggagcctgagattccagcccctatgtcagagctcacagagactgtggtctgcgccctgggattgtctgtgggc ctcgtgggcattgtggtgggcactgtcttcatcatccgaggcctgcgttcagttggtgcttccagacaccaagggc cCttgtga

DQA1*040102 (SEQ ID NO: 2431)

ctgaccatgttgcctcttatggtgtaaacttgtaccagtcttacggtccctctggccagtacacccatgaatttga tggagacgagcagttctacgtggacctggggaggaaggagactgtctggtgtttgcctgttctcagacaatttaga ...tttgacccgcaatttgcactgacaaacatcgctgtgacaaaacacaacttgaacatcctgattaaacgctcca actctactgctgctaccaatgaggttcctgaggtcacagtgttttccaagtctccTgtgacgctgggtcagcccaa caccctcatctgtcttgtggacaacatcttcctcctgtggtcaacatcacatggctgagcaatgggcactcagtc acagaaggtgtttctgagaccagcttcctctccaagagtgatcattccttcttcaagatcagttacctcaccttcc tcccttctgctgatgagatttatgactgcaaggtggagcactggggcctggacgagcctcttctgaaacactggg

DQA1*050101

(SEQ ID NO: 2432)

atgatcctaaacaaagctctgatgctgggggcccttgccctgaccaccgtgatgagccctgtggaggtgaagaca ttgtggctgaccacgtcgcctcttatggtgtaaacttgtaccagtcttacggtccctctggccagtacacccatga atttgatggagatgagcagttctacgtggacctggggaggaaggagactgtctggtgtttgcctgttctcagacaa tttaga...tttgacccgcaatttgcactgacaaacatcgctgtcctaaaacataacttgaacagtctgattaaac gctccaactctaccgctgctaccaatgaggttcctgaggtcacagtgttttccaagtctcccgtgacactgggtca gcccaacatcctcatctgtcttgtggacaacatctttcctcctgtggtcaacatcacatggctgagcaatgggcac tcagtcacagaaggtgtttctgagaccagcttcctctccaagagtgatcattccttcttcaagatcagttacctca ccctcctcccttctgctgaggagagttatgactgcaaggtggagcactggggcctggacAagcctcttctgaaaca ctgggagcctgagattccagcccctatgtcagagctcacagagactgtggtctgcgcccgggAttgtctgtgggc ctcgtgggcattgtggtgggcactgtcttcatcatccgaggcctgcgttcagttggtgcttccagacaccaagggc ccttgtga

DQA1*050102

(SEQ ID NO: 2433)

gaagacattgtggctgaccacgttgcctcttAtggtgtaaacttgtaccagtcttacggtccctctggccagtaca cccatgaatttgatggagatgagcagttctacgtggacctggggaggaaggagactgtctggtgtttgcctgttct cagacaatttaga...tttgacccgcaatttgcactgacaaacatcgctgtcctaaaacataacttgaacagTctg attaaacgctccaactctaccgctgctaccaat

DQA1*0502

(SEQ ID NO: 2434)

ggtgtaaacttgtaccagtcttacggtccctctggccagtacacccatgaatttgatggagatgagcagttctacg tggacctggggaggaaggagactgtctggtgtttgcctgttctcagacaatttaga...tttgaccGgcaatttgc actgacaaacatcgctgtcctaaaacataacttgaacagtctgattaaacgctccaactctaccgctgctacc

DQA1*0503

(SEQ ID NO: 2435)

atgatcctaaacaaagctctgatgctgggggcccttgccctgaccaccgtgatgagccctgtggaggtgaagaca ttgtggctgaccacgtcgcctcttatggtgtaaacttgtaccagtcttacggtccctctggccagtacacccatga atttgatggagatgagcagttctacgtggacctggggaggaaggagactgtctggtgtttgcctgttctcagacaa tttaga...tttgacccgcaatttgcactgacaaacatcgctgtcctaaaacataacttgaacagtctgattaaac gctccaactctaccgctgctaccaatgaggttcctgaggtcacagtgttttccaagtctcccgtgacactgggtca gcccaacatcctcatctgtcttgtggacaacatctttcctcctgtggtcaacatcacatggctgagcaatgggcac tcagtcacagaaggtgtttctgagaccagcttcctctccaagagtgatcattccttcttcaagatcagttacctca ccctcctcccttctTctgaggagagttatgactgcaaggtggagcactggggcctggacaagcctcttctgaaaca ctgggagcctgagattccagcccctatgtcagagctcacagagactgtggtctgcgcccgggattgtctgtgggc ctcgtgggcattgtggtgggcactgtcttcatcatccgaggcctgcgttcagttggtgcttccagacaccaagggc ccttgtga

DQA1*0504

(SEQ ID NO: 2436)

ctgaccacgtcgcctcttatggtgtaaacttgtaccagtcttacggtcTctctggccagtacacccatgaatttga tggagatgagcagttctacgtggacctggggaggaaggagactgtctggtgtttgcctgttctcagacaattta ...tttgacccgcaatttgcactgacaaacatcgctgtcctaaaacataacttgaacagtctgattaaacgctcca actctaccgctgctaccaatg

DQA1*0505

(SEQ ID NO: 2437)

atgatcctaaacaaagctctgatgctggggacccttgccctgaccaccgtgatgagccctgtggaggtgaagaca ttgtggctgaccacgtcgcctcttatggtgtaaacttgtaccagtcttacggtccctctggccagtacacccatga atttgatggagatgagcagttctacgtggacctggggaggaaggagactgtctggtgtttgcctgttctcagacaa tttaga...tttgacccgcaatttgcactgacaaacatcgctgtcctaaaacataacttgaacagtctgattaaac gctccaactctaccgctgctaccaatgaggttcctgaggtcacagtgttttccaagtctcccgtgacactgggtca gcccaacatcctcatctgtcttgtggacaacatctttcctcctgtggtcaacatcacatggctgagcaatgggcac tcagtcacagaaggtgtttctgagaccagcttcctctccaagagtgatcattccttcttcaagatcagttacctca ccctcctcccttctgctgaggagagttatgactgcaaggtggagcactggggActggacaagcctcttctgaaaca ctgggagcctgagattccagcccctatgtcagagctcacagagactgtggtctgcgccctggggttgtctgtgggc ctcgtgggcattgtggtgggcactgtcttcatcatccgaggcctgcgttcagttggtgcttccagacaccaagggc ccttgtga

DQA1*060101

(SEQ ID NO: 2438)

atgatcctaaacaaagctctgctgctggggggcccttgccctgaccaccgtgatgagccctgtggaggtgaagaca ttgtggctgaccatgttgcctcttatggtgtaaacttgtaccagtcttacggtccctctggccagtTcacccatga atttgatggagacgagcagttctacgtggacctggggaggaaggagactgtctggtgtttgcctgttctcagacaa tttaga...tttgacccgcaatttgcactgacaaacatcgctgtgacaaaacacaacttgaacatcctgattaaac gctccaactctaccgctgctaccaatgaggttcctgaggtcacagtgttttccaagtctcccgtgacGctgggtca gcccaacaccctcatctgtcttgtggacaacatctttcctcctgtggtcaacatcacatggctgagcaatgggcac tcagtcacagaaggtgtttctgagaccagcttcctctccaagagtgatcattccttcttcaagatcagttacctca ccttcctcccttctgctgatgagatttatgactgcaaggtggagcactggggcctggacgagcctcttctgaaaca ctgggagcctgagattccagcccctatgtcagagctcacagagactgtggtctgcgccctgggattgtctgtgggc ctcgtgggcattgtggtgggcactgtcttcatcatccgaggcctgcgttcagttggtgcttccagacaccaagggc cCttgtga

DQA1*060102

(SEQ ID NO: 2439)

ggtgtaaacttgtaccagtcttacggtccctctggccagttcacccatgaatttgatggagacgagcagttctacg tggacctggggaggaaggagactgtctggtgtttgcctgttctcagacaatttaga...tttgacccgcaatttgc actgacaaacatcgcCgtgacaaaacacaacttgaacatcctgattaaacgctccaactctaccgctgctaccaat ga

DQB1*050101

(SEQ ID NO: 2440)

gggcctgtgctacttcaccaacgggacggagcgcgtgcgggtgtgaccagacacatctataaccgagaggagtac gtgcgcttcgacagcgacgtgggggtgtaccgggcAgtgacgccgcaggggcggcctgTtgccgagtactggaaca gccagaaggaagtcctggagggggcccgggcgTcggtggacaGgtgtgcagacacaactacgaggtggcgtaccg cgggatcctgcagaggagagtggagcccacagtgaccatctccccatccaggacagaggccctcaaccaccacaac ctgctgatctgctcggtgacagatttctatccaagccagatcaaagtccggtggtttcggaatgatcaggaggaga cagccggcgttgtgtccaccccctcattaggaacggtgactggaccttccagatcctggtgatgctggaaatgac tccccagcgtggagatgtctacacctgccacgtggagcaccccagcctccagagcccatcaccgtggagtgg

DQB1*050102

(SEQ ID NO: 2441)

gggcctgtgctacttcaccaacgggacggagcgcgtgcgggtgtgaccagacacatctataaccgagaggagtac gtgcgcttcgacagcgacgtgggggtgtaccgggcggtgacgccgcaggggcggcctgttgccgagtactggaaca gccagaaggaagtcctggagggggcccgggcgtcggtggacagAgtgtgcagacacaactacgaggtggcgtaccg cgggatcctgcagagg

DQB1*050201

(SEQ ID NO: 2442)

gggcctgtgctacttcaccaacgggacggagcgcgtgcgggtgtgaccagacacatctataaccgagaggagtac gtgcgcttcgacagcgacgtgggggtgtaccgggcggtgacgccgcaggggcggcctagcgccgagtactggaaca gccagaaggaagtcctggagggggcccgggcgtcggtggacagagtgtgcagacacaactacgaggtggcgtaccg cgggatcctgcagaggagagtggagcccacagtgaccatctccccatccaggacagaggccctcaaccaccacaac ctgctgatctgctcggtgacagatttctatccaagccaCatcaaagtccggtggtttcggaatgatcaggaggaga cagccggcgttgtgtccacccccctcattaggaacggtgactggaccttccagatcctggtgatgctggaaatgac tccccagcgtggagatgtctacacctgccacgtggagcaccccagcctccagagcccatcaccgtggagtgg

DQB1*050202

(SEQ ID NO: 2443)

gggcctgtgctacttcaccaacgggacggagcgcgtgcgggtgtgaccagacacatctataaccgagaggagtac gtgcgcttcgacagcgacgtgggggtgtaTcgggcggtgacgccgcaggggcggcctaGCgccgagtactggaaca gccagaaggaagtcctggagggggcccgggcgtcggtggacagAgtgtgcagacacaactacgaggtggcgtaccg cgggatcctgcagagga

DQB1*050301

(SEQ ID NO: 2444)

gggcctgtgctacttcaccaacgggacggagcgcgtgcgggtgtgaccagacacatctataaccgagaggagtac gtgcgcttcgacagcgacgtgggggtgtatcgggcggtgacgccgcaggggcggcctgACgccgagtactggaaca gccagaaggaagtcctggagggggcccgggcgtcggtggacagAgtgtgcagacacaactacgaggtggcgtaccg cgggatcctgcagaggagagtggagcccacagtgaccatctccccatccaggacagaggccctcaaccaccacaac ctgctgatctgctcggtgacagatttctatccaagccagatcaaagtccggtggtttcggaatgatcaggaggaga cagccggcgttgtgtccacccccctcattaggaacggtgactggaccttccagatcctggtgatgctggaaatgac tccccagcgtggagatgtctacacctgccacgtggagcaccccagcctccagagcccatcaccgtggagtgg

DQB1*050302

(SEQ ID NO: 2445)

gacggagcgcgtgcggggtgtgaccagacacatctataaccgagaggagtacgtgcgcttcgacagcgacgtgggg gtgtaTcgggcggtgacgccgcaggggcggcctgAtgccgagtactggaacagccagaaggaagtcctggag

DQB1*0504

(SEQ ID NO: 2446)

gggcctgtgctacttcaccaacgggacggagcgcgtgcgggtgtgaccagatacatctataaccgagaagagtac gtgcgcttcgacagcgacgtgggggtgtaccgggcggtgacgccgcaggggcggcctaGcgccgagtactggaaca gccagaaggacatcctggaggAggaccgggcgtcggtggacagggtgtgcagacacaact

DQB1*0201

(SEQ ID NO: 2447)

gggcatgtgctacttcaccaacgggacagagcgcgtgcgtcttgtgagcagaagcatctataaccgagaagagatc gtgcgcttcgacagcgacgtgggggagttccggcggtgacgctgctggggctgcctgccgccgagtactggaaca gccagaaggacatcctggagaggaaAcgggcggcggtggacagggtgtgcagacacaactaccagttggagctccg cacgaccttgcagcggcgagtggagcccacagtgaccatctccccatccaggacagaggccctcaaccaccacaac ctgctggtctgctcggtgacagatttctatccagcccagatcaaagtccggtggtttcggaatgaccaggaggaga cagctggcgttgtgtccaccccccttattaggaatggtgactggaccttccagatcctggtgatgctggaaatgac tccccagcgtggagaCgtctacacctgccacgtggagcaccccagcctccagagcccatcaccgtggagtgg

DQB1*0202

(SEQ ID NO: 2448)

gggcatgtgctacttcaccaacgggacagagcgcgtgcgtcttgtgagcagaagcatctataaccgagaagagatc gtgcgcttcgacagcgacgtgggggagttccggcggtgacgctgctggggctgcctgccgccgagtactggaaca gccagaaggacatcctggagaggaaacgggcggcggtggacagggtgtgcagacacaactaccagttggagctccg cacgaccttgcagcggcgagtggagcccacagtgaccatctccccatccaggacagaggccctcaaccaccacaac ctgctggtctgctcggtgacagatttctatccagcccagatcaaagtccggtggtttcggaatgGccaggaggaga cagctggcgttgtgtccaccccccttattaggaatggtgactggaccttccagatcctggtgatgctggaaatgac tccccagcgtggagaCgtctacacctgccacgtggagcaccccagcctccagagccccatcaccgtggagtgg

DQB1*0203 (SEQ ID NO: 2449)

gggcatgtgctacttcaccaacgggacagagcgcgtgcgtcttgtgagcagaagcatctataaccgagaagagatc gtgcgcttcgacagcgacgtggggggagttccgggcggtgacgctgctggggctgcctgAcgccgagtactggaaca gccagaaggacatcctggagaggaaacgggcggcggtggacagggtgtgcagacacaactaccagttggagctccg cacgaccttgcagcggcgacccCatccaggacagaggccctcaaccaccacaacctgctggtctgctcggtgacag atttctatccagcccagatcaaagtccggtggtttcggaatgGccaggaggagacagctggcgttgtgtccacccc ccttattaggaatggtgactggaccttccagatcctggtgatgctggaaatgactccccagcgtggaga

DQB1*030101 (SEQ ID NO: 2450)

ggccatgtgctacttcaccaacgggacggagcgcgtgcgttatgtgaccagatacatctataaccgagaggagtac gcacgcttcgacagcgacgtggAggtgtaccggcggtgacgccgctggggccgcctgAcgccgagtactggaaca gccagaaggaagtcctggagaggacccgggcggagttggacacggtgtgcagacacaactaccagttggagctccg cacgaccttgcagcggcgagtggagcccacagtgaccatctccccatccaggacagaggccctcaaccaccacaac ctgctggtctgctcagtgacagatttctatccagcccagatcaaagtccggtggtttcggaatgaccaggaggaga caaccggcgttgtgtccaccccccttattaggaacggtgactggaccttccagatcctggtgatgctggaaatgac tccccagcatggagaCgtctacacctgccacgtggagcaccccagcctccagaAcccatcaccgtggagtgg

DQB1*030102 (SEQ ID NO: 2451)

ggccatgtgctacttcaccaacgggacggagcgcgtgcgttatgtgaccagatacatctataaccgagaggagtac gcgcgcttcgacagcgacgtggAggtgtaccggcggtgacgccgctggggccgcctgAcgccgagtactggaaca gccagaaggaagtcctggagaggacccgggcggagttggacacggtgtgcagacacaactaccagttggagctccg cacgaccttgcagcggcgag

DQB1*0302 (SEQ ID NO: 2452)

gggcatgtgctacttcaccaacgggacggagcgcgtgcgtcttgtgaccagatacatctataaccgagaggagtac gcAcgcttcgacagcgacgtgggggtgtatcggcggtgacgccgctggggccgcctgCcgccgagtactggaaca gccagaaggaagtcctggagaggacccgggcggagTtggacacggtgtgcagacacaactaccagttggagctccg cacgaccttgcagcggcgagtggagcccacagtgaccatctccccatccaggacagaggccctcaaccaccacaac ctgctggtctgctcagtgacagatttctatccagcccagatcaaagtccggtggtttcggaatgaccaggaggaga caactggcgttgtgtccaccccccttattaggaacggtgactggaccttccagatcctggtgatgctggaaatgac tccccagcgtggagacgtctacacctgccacgtggagcaccccagcctccagaacccatcaTcgtggagtgg

DQB1*030302 (SEQ ID NO: 2453)

gggcatgtgctacttcaccaacgggacggagcgcgtgcgtcttgtgaccagatacatctataaccgagaggagtac gcacgcttcgacagcgacgtgggggtgtatcggcggtgacgccgctggggccgcctgAcgccgagtactggaaca gccagaaggaagtcctggagaggacccgggcggagTtggacacggtgtgcagacacaactaccagttggagctccg cacgaccttgcagcggcgagtggagcccacagtgaccatctccccatccaggacagaggccctcaaccaccacaac ctgctggtctgctcagtgacagatttctatccagcccagatcaaagtccggtggtttcggaatgaccaggaggaga caactggcgttgtgtccaccccccttattaggaacggtgactggaccttccagatcctggtgatgctggaaatgac tccccagcgtggagacgtctacacctgccacgtggagcacccagcctccagaacccatcaTcgtggagtgg

DQB1*030303

(SEQ ID NO: 2454)

gggcatgtgctacttcaccaacgggacggagcgcgtgcgtcTtgtgaccagatacatctataaccgagaggagtac gcgcgcttcgacagcgacgtggggtgtaTcgggcggtgacgccgctggggcCgcctgAcgccgagtactggaaca gccagaaggaagtcctggagAggacccgggcggagTtggacacggtgtgcagacacaactaccagttggagctccg cacgaccttgcagcggcgag

DQB1*0304

(SEQ ID NO: 2455)

ggccatgtgctacttcaccaacgggacggagcgcgtgcgttatgtgaccagatacatctataaccgagaggagtac gcacgcttcgacagcgacgtggAggtgtaccggcggtgacgccgctggggccgcctgCcgccgagtactggaaca gccagaaggaagtcctggagaggacccgggcggagttggacacggtgtgcagacacaactaccagttggagctccg cacgaccttgcagcggcgagtggagcccacagtgaccatctccccatccaggacagaggccctcaaccaccacaac ctgctggtctgctcagtgacagatttctatccagcccagatcaaagtccggtggtttcggaatgaccaggaggaga caaccggcgttgtgtccaccccccttattaggaacggtgactggaccttccagatcctggtgatgctggaaatgac tccccagcatggagaCgtctacacctgccacgtggagcacccagcctccagaAccccatcaccgtggagtgg

DQB1*030501

(SEQ ID NO: 2456)

gggcatgtgctacttcaccaacgggacCgagcgcgtgcggggtgtgaccagatacatctataaccgagaggagtac gcgcgcttcgacagcgacgtggggtgtatcgggcggtgacgccgctggggccgcctgccgccgagtactggaaca gccagaaggaagtcctggagaggacccgggcggagTtggacacggtgtgcagacacaactaccagttggagctccg cacgaccttgcagcggcgagtggagcccacagtgaccatctccccatccaggacagaggccctcaaccaccacaac ctgctggtctgctcagtgacagatttctatccagcccagatcaaagtccggtggtttcggaatgaccaggaggaga caactggcgttgtgtccaccccccttattaggaacggtgactggaccttccagatcctggtgatgctggaaatgac tccccagcgtggagacgtctacacctgccacgtggagcacccagcctccagaacccatcatcgtggagtgg

DQB1*030502

(SEQ ID NO: 2457)

gggcatgtgctacttcaccaacgggacggagcgcgtgcggggtgtgaccagatacatctataaccgagaggagtac gcgcgcttcgacagcgacgtggggtgtaTcgggcggtgacgccgctggggccgcctgCcgccgagtactggaaca gccagaaggaagtcctggagAggacccgggcggagttggacaCggtgtgcagacacaactaccagttggagctccg cacgaccttgcagcggcgag

DQB1*0306

(SEQ ID NO: 2458)

gggcatgtgctacttcaccaacgggacggagcgcgtgcgtcttgtgaccagatacatctataaccgagaggagtac gcacgcttcgacagcgacgtggggtgtatcgggcggtgacgccgctggggcCgcctgacgccgagtactggaata gccagaaggacatcctggaggaggacccgggcgtcggtggacaccgtAtgcagacacaactaccagttggagctccg cacgaccttgcagcggcgag

DQB1*0307

(SEQ ID NO: 2459)

gggcatgtgctacttcaccaacgggacggagcgcgtgcgtcttgtgaccagatacatctataaccgagaggagtac gcacgcttcgacagcgacgtggggtgtatcgggTggtgacgccgctggggccgcctgccgccgagtactggaaca gccagaaggaagtcctggagaggacccgggcggagttggacacggtgtgcagacacaactaccagttggagctccg cacgaccttgcagcggcga DQB1*0308
(SEQ ID NO: 2460)
gggcatgtgctacttcaccaacgggacggagcgcgtgcgtcttgtgaccagatacatctataaccgagaggagtac gcAcgcttcgacagcgacgtgggggtgtaTcgggcggtgacgccgctggggccgcctgCcgccgagtactggaaca gccagaaggaagtcctggaggggacccgggcggagttggacaCggtgtgcagacacaactaccagttggagctccg cacgaccttgcagcggcgag DQB1*0309
(SEQ ID NO: 2461)
ggccatgtgctacttcaccaacgggacggagcgcgtgcgttatgtgaccagatacatctataaccgagaggagtac gcacgcttcgacagcgacgtggaggtgtaccggcggtgacgccgctggggccgcctgacgccgagtactggaaca gccagaaggaagtcctggagaggacccgggcggagttggacacggtgtgcagacacaactaccagttggagctccg cacgaccttgcagcggcgagtggagcccacagtgaccatctccccatccaggacagaggccctcaaccaccacaac ctgctggtctgctcagtgacagatttctatccagcccagatcaaagtccggtggtttcggaatgaccaggaggaga caaccggcgttgtgtccacccccttattaggaacggtgactggaccttccagatcctggtgatgctggaaatgac tccccagcatgcC...gtctacacctgccacgtggagcaccccagcctccagaacccatcaccgtggagtgg DQB1*0310
(SEQ ID NO: 2462)
ggccatgtgctacttcaccaacgggacggagcgcgtgcgttatgtgaccagatacatctataaccgagaggagtac gcacgcttcgacagcgacgtgggggtgtaTcgggcggtgacgccgctggggccgcctgAcgccgagtactggaaca gccagaaggaagtcctggagaggacccgggcggagttggacacggtgtgcagacacaactaccagttggagctccg cacgaccttgcagcggcgagtggagcccacagtgaccatctccccatccaggacagaggccctcaaccaccacaac ctgctggtctgctcagtgacagatttctatccagcccagatcaaagtccggtggtttcggaatgaccaggaggaga caaccggcgttgtgtccacccccttattaggaacggtgactggaccttccagatcctggtgatgctggaaatgac tccccagcAtggagaCgtctacacctgccacgtggagcaccccagcctccagaAcccatcaccgtggagtgg DQB1*0311
(SEQ ID NO: 2463)
gggcctgtgctacttcaccaacgggacggagcgcgtgcgtcttgtgaccagatacatctataaccgagaggagtac gcAcgcttcgacagcgacgtgggggtgtaTcgggcggtgacgccgctggggccgcctgCcgccgagtactggaaca gccagaaggaagtcctggagAggacccgggcggagttggacaCggtgtgcagacacaactaccagttggagctccg cacgaccttgcagcggcgag DQB1*0312
(SEQ ID NO: 2464)
ggccatgtgctacttcaccaacgggacggagcgcgtgcgtcTtgtgaccagatacatctataaccgagaggagtac gcAcgcttcgacagcgacgtgggggtgtaTcgggcggtgacgccgctggggccgcctgAcgccgagtactggaaca gccagaaggaagtcctggagAggacccgggcggagTtggacacggtgtgcagacacaactaccagttggagctccg cacgaccttgcagcggcgag DQB1*0313
(SEQ ID NO: 2465)
ggccatgtgctacttcaccaacgggacggagcgcgtgcgttatgtgaccagatacatctataaccgagaggagtac gcacgcttcgacagcgacgtggaggtgtaccggcggtgacgccgctggggccgcctgacgccgagtactggaaca gccagaaggaagAcctggagaggacccgggcggagttggacacggtgtgcagacacaactaccagttggagctccg cacgaccttgcagcggcgag DQB1*0401
(SEQ ID NO: 2466)
gggcatgtgctacttcaccaacgggaccgagcTcgtgcggggtgtgaccagatacatctataaccgagaggagtac gcgcgcttcgacagcgacgtgggggtgtatcggcggtgacgccgctggggcggcttgacgccgagtactggaata gccagaaggacatcctggaggaggacccgggcgtcggtggacaccgtatgcagacacaactaccagttggagctccg -continued cacgaccttgcagcggcgagtggagcccacagtgaccatctccccatccaggacagaggccctcaaccaccacaac ctgctggtctgctcagtgacagatttctatccagcccagatcaaagtccggtggtttcggaatgaccaggaggaga caactggcgttgtgtccaccccccttattaggaacggtgactggaccttccagatcctggtgatgctggaaatgac tccccagcgtggagacgtctacacctgccacgtggagcaccccagcctccagaacccatcatcgtggagtgg

DQB1*0402
(SEQ ID NO: 2467)

gggcatgtgctacttcaccaacgggaccgagcgcgtgcggggtgtgaccagatacatctataaccgagaggagtac gcgcgcttcgacagcgacgtgggggtgtatcgggcggtgacgccgctggggcggcTtgacgccgagtactggaata gccagaaggacatcctggaggaggaccgggcgtcggtggacaccgtatgcagacacaactaccagttggagctccg cacgaccttgcagcggcgagtggagcccacagtgaccatctccccatccaggacagaggccctcaaccaccacaac ctgctggtctgctcagtgacagatttctatccagcccagatcaaagtccggtggtttcggaatgaccaggaggaga caactggcgttgtgtccaccccccttattaggaacggtgactggaccttccagatcctggtgatgctggaaatgac tccccagcgtggagacgtctacacctgccacgtggagcaccccagcctccagaacccatcatcgtggagtgg

DQB1*060101
(SEQ ID NO: 2468)

ggccatgtgctacttcaccaaTgggacggagcgcgtgcgttatgtgaccagatacatctataaccgagaggaggac gtgcgcttcgacagcgacgtgggggtgtatcgggcggtgacgccgcaggggcggcctgacgccgagtactggaaca gccagaaggacatcctggagaggacccgagcggagttggacacggtgtgcagacacaactacgaggtggcgttccg cgggatcttgcagaggagagtggagcccacagtgaccatctccccatccaggacagaggccctcaaccaccacaac ctgctggtctgctcggtgacagatttctatccaggccagatcaaagtccggtggtttcggaatgaccaggaggaga cagctggcgttgtgtccaccccccttattaggaacggtgactggaccttccagatcctggtgatgctggaaatgac tccccagcatggagacgtctacacctgccacgtggagcaccccagcctccagagcccatcaccgtggagtgg

DQB1*060102
(SEQ ID NO: 2469)

gccatgtgctacttcaccaacgggacggagcgcgtgcgttatgtgaccagatacatctataaccgagaggaggacg tgcgcttcgacagcgacgtgggggtgtatcgggcggtgacCccgcaggggcggcctgacgccgagtactggaacag ccagaaggacatcctggagaggacccgagcggagttggacacggtgtgcaga

DQB1*060103
(SEQ ID NO: 2470)

ggccatgtgctacttcaccaatgggacggagcgcgtgcgttatgtgaccagatacatctataaccgagaggaggac gtgcgcttcgacagcgacgtgggggtgtatcgggcggtgacgccgcaggggcggcctgacgccgagtactggaaca gccagaaggacatcctggagaggacccgagcggagttggacacggtgtgcagacacaactacgaggtggcgttccg cgggatcttgcagaggagagtggagcccacagtgaccatctccccatccaggacagaggccctcaaccaccacaac ctgctggtctgctcggtgacagatttctatccaggccagatcaaagtccggtggtttcggaatgaccaggaAgaga cagctggcgttgtgtccaccccccttattaggaacggtgactggaccttccagatcctggtgatgctggaaatgac tccccagcatggagacgtctacacctgccacgtggagcaccccagcctccagagcccatcaccgtggagtgg

DQB1*0602
(SEQ ID NO: 2471)

gggcatgtgctacttcaccaacgggacggagcgcgtgcgtcttgtgaccagaTacatctataaccgagaggagtac gcgcgcttcgacagcgacgtgggggtgtaccgcgcggtgacgccgcaggggcggcctgatgccgagtactggaaca gccagaaggaagtcctggagggaccggcggagttggacacggtgtgcagacacaactacgaggtggcgttccg cgggatcTtgcagaggagagtggagcccacagtgaccatctccccatccaggacagaggccctcaaccaccacaac ctgctggtctgctcggtgacagatttctatccaggccagatcaaagtccggtggtttcggaatgatcaggaggaga cagcggcgttgtgtccaccccccttattaggaatggtgactggacTttccagatcctggtgatgctggaaatgac tccccagcgtggagatgtctacacctgccacgtggagcaccccagcctccagagcccatcaccgtggagtgg DQB1*0603
(SEQ ID NO: 2472)
gggcatgtgctacttcaccaacgggacggagcgcgtgcgtcttgtAaccagacacatctataaccgagaggagtac gcgcgcttcgacagcgacgtgggggtgtaccgcgcggtgacgccgcaggggcggcctgatgccgagtactggaaca gccagaaggaagtcctggaggggacccgggcggagttggacacggtgtgcagacacaactacgaggtggcgttccg cgggatcTtgcagaggagagtggagcccacagtgaccatctccccatccaggacagaggccctcaaccaccacaac ctgctggtctgctcggtgacagatttctatccaggccagatcaaagtccggtggtttcggaatgatcaggaggaga cagccggcgttgtgtccaccccccttattaggaatggtgactggacTttccagatcctggtgatgctggaaatgac tccccagcgtggagatgtctacacctgccacgtggagcaccccagcctccagagcccatcaccgtggagtgg DQB1*060401
(SEQ ID NO: 2473)
gggcatgtgctacttcaccaacgggacggagcgcgtgcgtcttgtaaccagacacatctataaccgagaggagtac gcgcgcttcgacagcgacgtgggggtgtaccgggcggtgacgccgcaggggcggcctgttgccgagtactggaaca gccagaaggaagtcctggagAggacccgggcggagttggacacggtgtgcagacacaactacgaggtggggtaccg cgggatcctgcagaggagagtggagcccacagtgaccatctccccatccaggacagaggccctcaaccaccacaac ctgctggtctgctcggtgacagatttctatccaggccagatcaaagtccAgtggtttcggaatgatcaggaggaga cagccggcgttgtgtccaccccccttattaggaatggtgactggactttccagatcctggtgatgctggaaatgac tccccagcgtggagatgtctacacctgccacgtggagcaccccagcctccagagcccatcaccgtggagtgg DQB1*060402
(SEQ ID NO: 2474)
gggcatgtgctacttcaccaacgggacggagcgcgtgcgtcttgtAaccagacacatctataaccgagaggagtac gcgcgcttcgacagcgacgtgggggtgtaccgCgcggtgacgccgcaggggcggcctgttgccgagtactggaaca gccagaaggaagtcctggagAggAcccgggcggagttggacacggtgtgcagacacaactacgaggtggGgtaccg cgggatcctgcagaggagagtggagcccacagtgaccatctccccatccaggacagaggcc DQB1*060501
(SEQ ID NO: 2475)
gggcctgtgctacttcaccaacgggacggagcgcgtgcgtcttgtAaccagaTacatctataaccgagaggagtac gcgcgcttcgacagcgacgtgggggtgtaccgggcggtgacgccgcaggggcggcctgttgccgagtactggaaca gccagaaggaagtcctggagAggAcccgggcggagttggacacggtgtgcagacacaactacgaggtggGgtaccg cgggatcctgcagaggagagtggagcccacagtgaccatctccccatccaggacagaggcc DQB1*060502
(SEQ ID NO: 2476)
ggacggagcgcgtgcgtcttgtAaccagatacatctataaccgagaggagtacgcgcgcttcgacagcgacgtggg ggtgtaccgggcggtgacgccgcaggggcggcctgtCgccgagtactggaacagccagaaggaagtcctggagAgg AcccgggcggagttggacaCg DQB1*0606
(SEQ ID NO: 2477)
ggacggagcgcgtgcgtcttgtAaccagaTacatctataaccgagaggagtacgcgcgcttcgacagcgacgtggg ggtgtaccgggcggtgacgccgcaggggcggcctgttgccgagtactggaacagccagaaggaagtcctggagAgg Acccgggcggcggtggacagggtg DQB1*0607
(SEQ ID NO: 2478)
gggcatgtgctacttcaccaacgggacggagcgcgtgcgtcttgtAaccagacacatctataaccgagaggagtac gcgcgcttcgacagcgacgtgggggtgtaccgcgcggtgacgccgcaggggcggcctgAtgccgagtactggaaca gccagaaggaagtcctggagAggAcccgggcggagttggacacggtgtgcagacacaactacgaggtggGgtaccg cgggatcc -continued DQB1*0608 (SEQ ID NO: 2479)
gggcatgtgctacttcaccaacgggacggagcgcgtgcgtcttgtAaccagacacatctataaccgagaggagtac
gcgcgcttcgacagcgacgtgggggtgtaccgCgcggtgacgccgcaggggcggcctgttgccgagtactggaaca
gccagaaggaagtcctggaggggacccgggcggagttggacacggtgtgcagacacaactacgaggtggcgttccg
cgggatcT DQB1*0609 (SEQ ID NO: 2480)
gggcatgtgctacttcaccaacgggacggagcgcgtgcgtcttgtaaccagaTacatctataaccgagaggagtac
gcgcgcttcgacagcgacgtgggggtgtaccgggcggtgacgccgcaggggcggcctgttgccgagtactggaaca
gccagaaggaagtcctggagAggacccgggcggagttggacacggtgtgcagacacaactacgaggtggggtaccg
cgggatcctgcagaggagagtggagcccacagtgaccatctccccatccaggacagaggccctcaaccaccacaac
ctgctggtctgctcggtgacagatttctatccaggccagatcaaagtccAgtggtttcggaatgatcaggaggaga
cagccggcgttgtgtccaccccccttattaggaatggtgactggactttccagatcctggtgatgctggaaatgac
tccccagcgtggagatgtctacacctgccacgtggagcacccagcctccagagcccatcaccgtggagtgg DQB1*0610 (SEQ ID NO: 2481)
gggcatgtgctacttcaccaacgggacggagcgcgtgcgtcttgtgaccagatacatctataaccgagaggagtac
gcgcgcttcgacagcgacgtgggggtgtaccgcgcggtgacgccgcaggggcggcctaGcgccgagtactggaaca
gccagaaggaagtcctggaggggacccgggcggagttggacacggtgtgcagacacaactacgaggtggcgttccg
cgggatcTtgcagaggagag DQB1*061101 (SEQ ID NO: 2482)
gggcatgtgctacttcaccaacgggacggagcgcgtgcgtcttgtgaccagaTacatctataaccgagaggagtac
gcgcgcttcgacagcgacgtgggggtgtaccgCgcggtgacgccgcaggggcggcctgAtgccgagtactggaaca
gccagaaggaagtcctggaggggacccgggcggagttggacacggtgtgcagacacaactacgaggtggcgttccg
cgggatcTtgcagagg DQB1*061102 (SEQ ID NO: 2483)
gggcatgtgctacttcaccaacgggacggagcgcgtgcgtcttgtAaccagaTacatctataaccgagaggagtac
gcgcgcttcgacagcgacgtgggggtgtaccgCgcggtgacgccgcaggggcggcctgAtgccgagtactggaaca
gccagaaggaagtcctggaggggacccgggcggagttggacacggtgtgcagacacaactacgaggtggcgttccg
cgggatcTtgcagaggagag DQB1*0612 (SEQ ID NO: 2484)
gggcatgtgctacttcaccaacgggacggagcgcgtgcgtcttgtaaccagaTacatctataaccgagaggagtac
gcgcgcttcgacagcgacgtgggggtgtaccgggcggtgacgccgcaggggcggcctgttgccgagtactggaaca
gccagaaggaagtcctggaggggacccgggcggagttggacacggtgtgcagacacaactacgaggtggggtaccg
cgggatcctgcagaggagagtggagcccacagtgaccatctccccatccaggacagaggccctcaaccaccacaac
ctgctggtctgctcggtgacagatttctatccaggccagatcaaagtccAgtggtttcggaatgatcaggaggaga
cagccggcgttgtgtccaccccccttattaggaatggtgactggactttccagatcctggtgatgctggaaatgac
tccccagcgtggagatgtctacacctgccacgtggagcacccagcctccagagcccatcaccgtggagtgg DQB1*0613 (SEQ ID NO: 2485)
gggcatgtgctacttcaccaacgggacggagcgcgtgcgtcttgtgaccagaTacatctataaccgagaggagtac
gcgcgcttcgacagcgacgtgggggtgtaccgCgcggtgacgccgcaggggcggcctgttgccgagtactggaaca

DQB1*0614

(SEQ ID NO: 2486)

gggcatgtgctacttcaccaacgggacggagcgcgtgcgtcttgtAaccagacacatctataaccgagaggagtac gcgcgcttcgacagcgacgtgggggtgtaccgCgcggtgacgccgcaggggcggcctgAtgccgagtactggaaca gccagaaggaagtcctggaggggacccgggcggagttggacacggtgtgcagacacaactacgaggtggcgttccg cgggatcTtgcagaggagag

DQB1*0615

(SEQ ID NO: 2487)

gggcatgtgctacttcaccaacgggacggagcgcgtgcgtcttgtgaccagaTacatctataaccgagaggagtac gcgcgcttcgacagcgacgtgggggtgtaccgcgcggtgacgccgcaggggcggcctgAtgccgagtactggaaca gccagaaggaagtcctggagAggAcccgggcggagttggacacggtgtgcagacacaactacgaggtggGtaccg cgggatcctgcagaggagag

DQB1*0616

(SEQ ID NO: 2488)

gggcatgtgctacttcaccaacgggacggagcgcgtgcgtcttgtgaccagatacatctataaccgagaggagtac gcgcgcttcgacagcgacgtgggggtgtaccgcgcggtgacgccgcaggggcggcctgatgccgagAactggaaca gccagaaggaagtcctggaggggacccgggcggagttggacacggtgtgcagacacaactacgaggtggcgttccg cgggatcttgcagaggagag

DQB1*0617

(SEQ ID NO: 2489)

gggcatgtgctacttcaccaacgggacggagcgcgtgcgtcttgtAaccagacacatctataaccgagaggagtac gcgcgcttcgacagcgacgtgggggtgtaccgggcggtgacgccgcaggggcggcctgttgccgagtactggaaca gccagaaggaagtcctggagggggcccgggcggagttggacacggtgtgcagacacaactacgaggtggGtaccgc

DQB1*0618

(SEQ ID NO: 2490)

gggcatgtgctacttcaccaacgggacggagcgcgtgcgtcttgtAaccagatacatctataaccgagaggagtac gcgcgcttcgacagcgacgtgggggtgtaccgggcggtgacgccgcaggggcggcctgttgccgagtactggaaca gccagaaggaagtcctggagAggacccgggcggagttggacacggtgtgcagacacaactacgaggtggcgttccg cgggatcTtgcagaggag

DQB1*0619

(SEQ ID NO: 2491)

gggcatgtgctacttcaccaacgggacggagcgcgtgcgtcTtgtgaccagatacatctataaccgagaggagtac gcgcgcttcgacagcgacgtgggggtgtaTcgggcggtgacgccgcTggggcggcctgAtgccgagtactggaaca gccagaaggaagtcctggaggggacccgggcggagTtggacacggtgtgcagacacaactacgaggtggcgttccg cgggatcTtgcagaggagag

DQB1*0620

(SEQ ID NO: 2492)

gggcctgtgctacttcaccaacgggacggagcgcgtgcgtcttgtgaccagaTacatctataaccgagaggagtac gcgcgcttcgacagcgacgtgggggtgtaccgCgcggtgacgccgcaggggcggcctgAtgccgagtactggaaca gccagaaggaagtcctggaggggacccgggcggagttggacacggtgtgcagacacaactacgaggtggcgtTccgc In the following, Probe Lists DQ1 and DQ2 are shown in Tables 17A, 17B-1 and 17B-2 and tables 18A, 18B-1 and 18B-2 respectively. Tables 19A, 19B-1 and 19B-2 and Tables 20A, 20B-1 and 20B-2 show Allele-Prove Lists.

TABLE 17A

| Probe No. | Base Sequence | |
|---|---|---|
| 0 | t gaa ttt gat gga gat gag G | (SEQ ID No: 2249) |
| 1 | ggt gct tcc aga cac caG | (SEQ ID No: 2250) |
| 2 | gg ttg tct gtg ggc ctc A | (SEQ ID No: 2251) |
| 3 | cag ccc aac acc ctc atC | (SEQ ID No: 2252) |
| 4 | g ctg agc aat ggg cac G | (SEQ ID No: 2253) |
| 5 | ca gag act gtg gtc tgc A | (SEQ ID No: 2254) |
| 6 | c cct tgt gga ggt gaa gG | (SEQ ID No: 2255) |
| 7 | cct gtg gtc aac atc acC | (SEQ ID No: 2256) |
| 8 | ccc tgt gga ggt gaa gG | (SEQ ID No: 2257) |
| 9 | c ctg gag agg aag gag G | (SEQ ID No: 2258) |
| 10 | tg cct ctg ttc cac aga C | (SEQ ID No: 2259) |
| 11 | x ag cct gag att cca A | (SEQ ID No: 2260) |
| 12 | gcc ctg acc acc gtg aC | (SEQ ID No: 2261) |
| 13 | c acc ttc ctc cct tct gA | (SEQ ID No: 2262) |
| 14 | tt aaa cgc tcc aac tct acT | (SEQ ID No: 2263) |
| 15 | cc aga cac caa ggg ccC | (SEQ ID No: 2264) |
| 16 | ca gtg ttt tcc aag tct ccT | (SEQ ID No: 2265) |
| 17 | g cac tgg ggc ctg gac A | (SEQ ID No: 2266) |
| 18 | g gtc tgc gcc ctg ggA | (SEQ ID No: 2267) |
| 19 | ct gac cac gtt gcc tct tA | (SEQ ID No: 2268) |
| 20 | c cta aaa cat aac ttg aac agT | (SEQ ID No: 2269) |
| 21 | c aga caa ttt aga ttt gac cG | (SEQ ID No: 2270) |
| 22 | tc acc ctc ctc cct tct T | (SEQ ID No: 2271) |
| 23 | tg tac cag tct tac ggt cT | (SEQ ID No: 2272) |
| 24 | ag gtg gag cac tgg ggA | (SEQ ID No: 2273) |
| 25 | ggt ccc tct ggc cag tT | (SEQ ID No: 2274) |
| 26 | cc aag tct ccc gtg acG | (SEQ ID No: 2275) |
| 27 | gca ctg aca aac atc gcC | (SEQ ID No: 2276) |

TABLE 17B-1

| Probe No. | Base Sequence | |
|---|---|---|
| 0 | g ggg gtg tac cgg gcA | (SEQ ID No: 2277) |
| 1 | cg cag ggg cgg cct gT | (SEQ ID No: 2278) |
| 2 | ag ggg gcc cgg gcg T | (SEQ ID No: 2279) |
| 3 | gg gcg tcg gtg gac aG | (SEQ ID No: 2280) |
| 4 | gg gcg tcg gtg gac agA | (SEQ ID No: 2281) |
| 5 | ca gat ttc tat cca agc caC | (SEQ ID No: 2282) |
| 6 | gc gac gtg ggg gtg taT | (SEQ ID No: 2283) |
| 7 | cg cag ggg cgg cct aG | (SEQ ID No: 2284) |
| 8 | g cag ggg cgg cct agC | (SEQ ID No: 2285) |

TABLE 17B-1-continued

| Probe No. | Base Sequence | |
|---|---|---|
| 9 | cg cag ggg cgg cct gA | (SEQ ID No: 2286) |
| 10 | g cag ggg cgg cct gaC | (SEQ ID No: 2287) |
| 11 | g aag gac atc ctg gag gA | (SEQ ID No: 2288) |
| 12 | g gac atc ctg gag agg aaA | (SEQ ID No: 2289) |
| 13 | ct ccc cag cgt gga gaC | (SEQ ID No: 2290) |
| 14 | c cgg tgg ttt cgg aat gG | (SEQ ID No: 2291) |
| 15 | ctg ctg ggg ctg cct gA | (SEQ ID No: 2292) |
| 16 | c ttc gac agc gac gtg gA | (SEQ ID No: 2293) |
| 17 | cg ctg ggg ccg cct gA | (SEQ ID No: 2294) |
| 18 | ct ccc cag cat gga gaC | (SEQ ID No: 2295) |
| 19 | cac ccc agc ctc cag aA | (SEQ ID No: 2296) |
| 20 | aac cga gag gag tac gcA | (SEQ ID No: 2297) |
| 21 | g ctg ggg ccg cct gC | (SEQ ID No: 2298) |
| 22 | agg acc cgg gcg gag T | (SEQ ID No: 2299) |
| 23 | c ctc cag aac ccc atc aT | (SEQ ID No: 2300) |
| 24 | cg gag cgc gtg cgt cT | (SEQ ID No: 2301) |
| 25 | g acg ccg ctg ggg cC | (SEQ ID No: 2302) |
| 26 | cag aag gaa gtc ctg gag A | (SEQ ID No: 2303) |
| 27 | tac ttc acc aac ggg acC | (SEQ ID No: 2304) |

TABLE 17B-2

| Probe No. | Base Sequence | |
|---|---|---|
| 28 | cgg gcg gag ttg gac aC | (SEQ ID No: 2305) |
| 29 | cg tcg gtg gac acc gtA | (SEQ ID No: 2306) |
| 30 | gtg ggg gtg tat cgg gT | (SEQ ID No: 2307) |
| 31 | tg act ccc cag cat gcC | (SEQ ID No: 2308) |
| 32 | g gaa atg act ccc cag cA | (SEQ ID No: 2309) |
| 33 | gg aac agc cag aag gaa gA | (SEQ ID No: 2310) |
| 34 | acc aac ggg acc gag cT | (SEQ ID No: 2311) |
| 35 | g ccg ctg ggg cgg cT | (SEQ ID No: 2312) |
| 36 | cc atg tgc tac ttc acc aaT | (SEQ ID No: 2313) |
| 37 | tg tat cgg gcg gtg acC | (SEQ ID No: 2314) |
| 38 | g ttt cgg aat gac cag gaA | (SEQ ID No: 2315) |
| 39 | gtg cgt ctt gtg acc aga T | (SEQ ID No: 2316) |
| 40 | g gcg ttc cgc ggg atc T | (SEQ ID No: 2317) |
| 41 | t agg aat ggt gac tgg acT | (SEQ ID No: 2318) |
| 42 | gag cgc gtg cgt ctt gtA | (SEQ ID No: 2319) |
| 43 | ca ggc cag atc aaa gtc cA | (SEQ ID No: 2320) |
| 44 | c gtg ggg gtg tac cgC | (SEQ ID No: 2321) |
| 45 | ag gaa gtc ctg gag agg A | (SEQ ID No: 2322) |
| 46 | a cac aac tac gag gtg gG | (SEQ ID No: 2323) |
| 47 | gtg cgt ctt gta acc aga T | (SEQ ID No: 2324) |
| 48 | g cag ggg cgg cct gtC | (SEQ ID No: 2325) |
| 49 | c aac tac gag gtg gcg tT | (SEQ ID No: 2326) |
| 50 | g cgg cct gat gcc gag A | (SEQ ID No: 2327) |
| 51 | gg gcg gtg acg ccg cT | (SEQ ID No: 2328) |
| 52 | cg ctg ggg cgg cct gA | (SEQ ID No: 2329) |
| 53 | ggg acc cgg gcg gag T | (SEQ ID No: 2330) |

TABLE 18A

| Probe No. | Base Sequence | |
|---|---|---|
| 0 | gga gat gag Gag ttc tac g | (SEQ ID No: 2331) |
| 1 | c aga cac caG ggg cca tt | (SEQ ID No: 2332) |
| 2 | gtg ggc ctc Atg ggc att | (SEQ ID No: 2333) |
| 3 | c acc ctc atC tgt ctt gtg | (SEQ ID No: 2334) |
| 4 | aat ggg cac Gca gtc aca | (SEQ ID No: 2335) |
| 5 | g gtc tgc Acc ctg ggg | (SEQ ID No: 2336) |
| 6 | ga ggt gaa gGc att gtg g | (SEQ ID No: 2337) |
| 7 | c aac atc acC tgg ctg ag | (SEQ ID No: 2338) |
| 8 | gg aag gag Gct gcc tgg | (SEQ ID No: 2339) |
| 9 | ctg ttc cac aga Ctt aga c c ttt | (SEQ ID No: 2340) |
| 10 | gag att cca Aca cct atg tc | (SEQ ID No: 2341) |

TABLE 18A-continued

| Probe No. | Base Sequence | |
|---|---|---|
| 11 | c acc gtg aCg agc cct t | (SEQ ID No: 2342) |
| 12 | ctc cct tct gAt gat gag at | (SEQ ID No: 2343) |
| 13 | c aac tct acT gct gct acc | (SEQ ID No: 2344) |
| 14 | c atc atc cGa ggc ctg c | (SEQ ID No: 2345) |
| 15 | c aag tct ccT gtg acg ct | (SEQ ID No: 2346) |
| 16 | ggc ctg gac Aag cct ctt | (SEQ ID No: 2347) |
| 17 | c gcc ctg ggA ttg tct gt | (SEQ ID No: 2348) |
| 18 | gtt gcc tct tAt ggt gta aa | (SEQ ID No: 2349) |
| 19 | aac ttg aac agT ctg att aaa c | (SEQ ID No: 2350) |
| 20 | a cg ttt gac cGg caa ttt gca c | (SEQ ID No: 2351) |
| 21 | ctc cct tct Tct gag gag | (SEQ ID No: 2352) |
| 22 | ct tac ggt cTc tct ggc c | (SEQ ID No: 2353) |
| 23 | g cac tgg ggA ctg gac aa | (SEQ ID No: 2354) |
| 24 | ct ggc cag tTc acc cat g | (SEQ ID No: 2355) |
| 25 | ccc gtg acG ctg ggt c | (SEQ ID No: 2356) |
| 26 | ca aac atc gcC gtg aca aaa | (SEQ ID No: 2357) |

TABLE 18B-1

| Probe No. | Base Sequence | |
|---|---|---|
| 0 | tac cgg gcA gtg acg cc | (SEQ ID No: 2358) |
| 1 | g cgg cct gTt gcc gag | (SEQ ID No: 2359) |
| 2 | c cgg gcg Tcg gtg gac | (SEQ ID No: 2360) |
| 3 | g gtg gac aGg gtg tgc a | (SEQ ID No: 2361) |
| 4 | g gtg gac agA gtg tgc ag | (SEQ ID No: 2362) |
| 5 | t cca agc caC atc aaa gtc | (SEQ ID No: 2363) |
| 6 | ggg gtg taT cgg gcg g | (SEQ ID No: 2364) |
| 7 | g cgg cct aGc gcc gag | (SEQ ID No: 2365) |
| 8 | cgg cct agC gcc gag t | (SEQ ID No: 2366) |
| 9 | g cgg cct gAc gcc gag | (SEQ ID No: 2367) |
| 10 | cgg cct gaC gcc gag t | (SEQ ID No: 2368) |
| 11 | g cgg cct gAt gcc gag | (SEQ ID No: 2369) |
| 12 | c ctg gag gAg gac cgg | (SEQ ID No: 2370) |
| 13 | gag agg aaA cgg gcg gc | (SEQ ID No: 2371) |
| 14 | g cgt gga gaC gtc tac ac | (SEQ ID No: 2372) |
| 15 | t cgg aat gGc cag gag g | (SEQ ID No: 2373) |
| 16 | g ctg cct gAc gcc gag | (SEQ ID No: 2374) |
| 17 | c gac gtg gAg gtg tac c | (SEQ ID No: 2375) |
| 18 | g ccg cct gAc gcc gag | (SEQ ID No: 2376) |
| 19 | g cat gga gaC gtc tac ac | (SEQ ID No: 2377) |
| 20 | gc ctc cag aAc ccc atc a | (SEQ ID No: 2378) |
| 21 | g gag tac gcA cgc ttc ga | (SEQ ID No: 2379) |
| 22 | ccg cct gCc gcc gag | (SEQ ID No: 2380) |
| 23 | gg gcg gag Ttg gac acg | (SEQ ID No: 2381) |
| 24 | ac ccc atc aTc gtg gag t | (SEQ ID No: 2382) |
| 25 | gc gtg cgt cTt gtg acc a | (SEQ ID No: 2383) |
| 26 | g ctg ggg cCg cct gac | (SEQ ID No: 2384) |
| 27 | c ctg gag Agg acc cgg | (SEQ ID No: 2385) |

TABLE 18B-2

| Probe No. | Base Sequence | |
|---|---|---|
| 28 | aac ggg acC gag cgc g | (SEQ ID No: 2386) |
| 29 | ag ttg gac aCg gtg tgc a | (SEQ ID No: 2387) |

TABLE 18B-2-continued

| Probe No. | Base Sequence | |
|---|---|---|
| 30 | g gac acc gtA tgc aga ca | (SEQ ID No: 2388) |
| 31 | g tat cgg gTg gtg acg c | (SEQ ID No: 2389) |
| 32 | cc cag cat gcC g t gtc tac | (SEQ ID No: 2390) |
| 33 | t ccc cag cAt gga gac g | (SEQ ID No: 2391) |
| 34 | ag aag gaa gAc ctg gag ag | (SEQ ID No: 2392) |
| 35 | g acc gag cTc gtg cgg | (SEQ ID No: 2393) |
| 36 | g ggg cgg cTt gac gcc | (SEQ ID No: 2394) |
| 37 | c ttc acc aaT ggg acg ga | (SEQ ID No: 2395) |
| 38 | gcg gtg acC ccg cag g | (SEQ ID No: 2396) |
| 39 | t gac cag gaA gag aca gc | (SEQ ID No: 2397) |
| 40 | t gtg acc aga Tac atc tat aa | (SEQ ID No: 2398) |
| 41 | gc ggg atc Ttg cag agg | (SEQ ID No: 2399) |
| 42 | t gac tgg acT ttc cag atc | (SEQ ID No: 2400) |
| 43 | g cgt ctt gtA acc aga cac | (SEQ ID No: 2401) |
| 44 | tc aaa gtc cAg tgg ttt cg | (SEQ ID No: 2402) |
| 45 | gtg tac cgC gcg gtg ac | (SEQ ID No: 2403) |
| 46 | g gag agg Acc cgg gcg | (SEQ ID No: 2404) |
| 47 | c gag gtg gGg tac cgc | (SEQ ID No: 2405) |
| 48 | g cgt ctt gtA acc aga tac | (SEQ ID No: 2406) |
| 49 | t gta acc aga Tac atc tat aac | (SEQ ID No: 2407) |
| 50 | cgg cct gtC gcc gag t | (SEQ ID No: 2408) |
| 51 | c cgg gcg gAg ttg gac | (SEQ ID No: 2409) |
| 52 | g gtg gcg tTc cgc ggg | (SEQ ID No: 2410) |
| 53 | gat gcc gag Aac tgg aac | (SEQ ID No: 2411) |
| 54 | acg ccg cTg ggg cgg | (SEQ ID No: 2412) |

TABLE 19A

| Allele Number | Probe Number for Detection | | |
|---|---|---|---|
| DQA1*010101 | 0 | | |
| DQA1*010102 | 1 | | |
| DQA1*010201 | 2 | | |
| DQA1*010202 | 3 | 2 | |
| DQA1*0103 | 4 | | |
| DQA1*010401 | 5 | | |
| DQA1*010402 | 6 | 7 | |
| DQA1*0105 | 8 | | |
| DQA1*0106 | 9 | | |
| DQA1*0201 | 10 | | |
| DQA1*030101 | 11 | | |
| DQA1*0302 | 12 | | |
| DQA1*0303 | 13 | | |
| DQA1*040101 | 14 | 15 | |
| DQA1*040102 | 16 | | |
| DQA1*050101 | 17 | 18 | |
| DQA1*050102 | 19 | 20 | |
| DQA1*0502 | 21 | | |
| DQA1*0503 | 22 | | |
| DQA1*0504 | 23 | | |
| DQA1*0505 | 24 | | |
| DQA1*060101 | 25 | 26 | 15 |
| DQA1*060102 | 27 | | |

TABLE 19B-1

| Allele Number | Probe Number for Detection | | | |
|---|---|---|---|---|
| DQB1*050101 | 0 | 1 | 2 | 3 |
| DQB1*050102 | 4 | | | |
| DQB1*050201 | 5 | | | |
| DQB1*050202 | 6 | 7 | 8 | 4 |
| DQB1*050301 | 9 | 10 | 4 | |
| DQB1*050302 | 6 | 11 | | |
| DQB1*0504 | 7 | 12 | | |
| DQB1*0201 | 13 | 14 | | |
| DQB1*0202 | 15 | 14 | | |
| DQB1*0203 | 16 | 15 | | |

TABLE 19B-1-continued

| Allele Number | Probe Number for Detection | | | | |
|---|---|---|---|---|---|
| DQB1*030101 | 17 | 18 | 19 | 20 | |
| DQB1*030102 | 17 | 18 | | | |
| DQB1*0302 | 21 | 22 | 23 | 24 | |
| DQB1*030302 | 18 | 23 | 24 | | |
| DQB1*030303 | 25 | 6 | 26 | 18 | 27 | 23 |
| DQB1*0304 | 17 | 22 | 19 | 20 | |
| DQB1*030501 | 28 | 23 | | | |
| DQB1*030502 | 6 | 22 | 27 | 29 | |
| DQB1*0306 | 26 | 30 | | | |
| DQB1*0307 | 31 | | | | |
| DQB1*0308 | 21 | 6 | 22 | 29 | |
| DQB1*0309 | 32 | | | | |
| DQB1*0310 | 6 | 18 | 33 | 19 | 20 |
| DQB1*0311 | 21 | 6 | 22 | 27 | 29 |
| DQB1*0312 | 25 | 21 | 6 | 18 | 27 | 23 |
| DQB1*0313 | 34 | | | | |
| DQB1*0401 | 35 | | | | |
| DQB1*0402 | 36 | | | | |
| DQB1*060101 | 37 | | | | |
| DQB1*060102 | 38 | | | | |
| DQB1*060103 | 39 | | | | |
| DQB1*0602 | 40 | 41 | 42 | | |
| DQB1*0603 | 43 | 41 | 42 | | |

TABLE 19B-2

| Allele Number | Probe Number for Detection | | | | |
|---|---|---|---|---|---|
| DQB1*060401 | 27 | 44 | | | |
| DQB1*060402 | 43 | 45 | 27 | 46 | 47 |
| DQB1*060501 | 48 | 49 | 27 | 46 | 47 |
| DQB1*060502 | 48 | 50 | 27 | 46 | 51 |
| DQB1*0606 | 48 | 49 | 27 | 46 | |
| DQB1*0607 | 43 | 11 | 27 | 46 | 47 |
| DQB1*0608 | 43 | 45 | 52 | | |
| DQB1*0609 | 49 | 27 | 44 | | |
| DQB1*0610 | 7 | 41 | | | |
| DQB1*061101 | 40 | 45 | 11 | 52 | |
| DQB1*061102 | 48 | 49 | 45 | 11 | 41 |
| DQB1*0612 | 49 | 44 | | | |
| DQB1*0613 | 40 | 45 | 52 | | |
| DQB1*0614 | 43 | 45 | 11 | 41 | |
| DQB1*0615 | 40 | 11 | 27 | 46 | 47 |
| DQB1*0616 | 53 | | | | |
| DQB1*0617 | 43 | 29 | | | |
| DQB1*0618 | 48 | 27 | 41 | | |
| DQB1*0619 | 25 | 6 | 54 | 11 | 23 | 41 |
| DQB1*0620 | 40 | 45 | 11 | | |

TABLE 20A

| Allele Number | Probe Number for Detection | |
|---|---|---|
| DQA1*010101 | 0 | |
| DQA1*010102 | 1 | |
| DQA1*010201 | 2 | |
| DQA1*010202 | 3 | 2 |
| DQA1*0103 | 4 | |
| DQA1*010401 | 5 | |
| DQA1*010402 | 6 | 7 |
| DQA1*0105 | 6 | |
| DQA1*0106 | 8 | |
| DQA1*0201 | 9 | |
| DQA1*030101 | 10 | |
| DQA1*0302 | 11 | |
| DQA1*0303 | 12 | |
| DQA1*040101 | 13 | 14 |
| DQA1*040102 | 15 | |
| DQA1*050101 | 16 | 17 |
| DQA1*050102 | 18 | 19 |
| DQA1*0502 | 20 | |
| DQA1*0503 | 21 | |
| DQA1*0504 | 22 | |

TABLE 20A-continued

| Allele Number | Probe Number for Detection | | |
|---|---|---|---|
| DQA1*0505 | 23 | | |
| DQA1*060101 | 24 | 25 | 14 |
| DQA1*060102 | 26 | | |

TABLE 20B-1

| Allele Number | Probe Number for Detection | | | | |
|---|---|---|---|---|---|
| DQB1*050101 | 0 | 1 | 2 | 3 | |
| DQB1*050102 | 4 | | | | |
| DQB1*050201 | 5 | | | | |
| DQB1*050202 | 6 | 7 | 8 | 4 | |
| DQB1*050301 | 9 | 10 | 4 | | |
| DQB1*050302 | 6 | 11 | | | |
| DQB1*0504 | 7 | 12 | | | |
| DQB1*0201 | 13 | 14 | | | |
| DQB1*0202 | 15 | 14 | | | |
| DQB1*0203 | 16 | 15 | | | |
| DQB1*030101 | 17 | 18 | 19 | 20 | |
| DQB1*030102 | 17 | 18 | | | |
| DQB1*0302 | 21 | 22 | 23 | 24 | |
| DQB1*030302 | 18 | 23 | 24 | | |
| DQB1*030303 | 25 | 6 | 26 | 18 | 27 | 23 |
| DQB1*0304 | 17 | 22 | 19 | 20 | |
| DQB1*030501 | 28 | 23 | | | |
| DQB1*030502 | 6 | 22 | 27 | 29 | |
| DQB1*0306 | 26 | 30 | | | |
| DQB1*0307 | 31 | | | | |
| DQB1*0308 | 21 | 6 | 22 | 29 | |
| DQB1*0309 | 32 | | | | |
| DQB1*0310 | 6 | 18 | 33 | 19 | 20 |
| DQB1*0311 | 21 | 6 | 22 | 27 | 29 |
| DQB1*0312 | 25 | 21 | 6 | 18 | 27 | 23 |
| DQB1*0313 | 34 | | | | |
| DQB1*0401 | 35 | | | | |
| DQB1*0402 | 36 | | | | |
| DQB1*060101 | 37 | | | | |
| DQB1*060102 | 38 | | | | |
| DQB1*060103 | 39 | | | | |
| DQB1*0602 | 40 | 41 | 42 | | |
| DQB1*0603 | 43 | 41 | 42 | | |

TABLE 20B-2

| Allele Number | Probe Number for Detection | | | | |
|---|---|---|---|---|---|
| DQB1*060401 | 27 | 44 | | | |
| DQB1*060402 | 43 | 45 | 27 | 46 | 47 |
| DQB1*060501 | 48 | 49 | 27 | 46 | 47 |
| DQB1*060502 | 48 | 50 | 27 | 46 | 51 |
| DQB1*0606 | 48 | 49 | 27 | 46 | |
| DQB1*0607 | 43 | 11 | 27 | 46 | 47 |
| DQB1*0608 | 43 | 45 | 52 | | |
| DQB1*0609 | 49 | 27 | 44 | | |
| DQB1*0610 | 7 | 41 | | | |
| DQB1*061101 | 40 | 45 | 11 | 52 | |
| DQB1*061102 | 48 | 49 | 45 | 11 | 41 |
| DQB1*0612 | 49 | 44 | | | |
| DQB1*0613 | 40 | 45 | 52 | | |
| DQB1*0614 | 43 | 45 | 11 | 41 | |
| DQB1*0615 | 40 | 11 | 27 | 46 | 47 |
| DQB1*0616 | 53 | | | | |
| DQB1*0617 | 43 | 29 | | | |
| DQB1*0618 | 48 | 27 | 41 | | |
| DQB1*0619 | 25 | 6 | 54 | 11 | 23 | 41 |
| DQB1*0620 | 40 | 45 | 11 | | |

Example 11

Probes for Identification of HLA-DR Allele

Extraction of DNA from 1 ml of human blood was performed using GFX Genomic Blood DNA Purification Kit from Amersham Biosciences in the same manner as in Example 1.

Next, quantitative PCR was carried out in the same manner as in Example 1 except that probes in the probe list 1 in Tables 21-1 and 21-2 were used and 4 µl of the mixed primers consisting of 1 µl each of respective solutions of the following primers (10 pmol/µl) and 4 µl of ultra pure water were used:

```
AGAGTACTCCAAGAAACGTG    (SEQ ID NO: 3314)

CCGCTGCACCGTGAAGCT      (SEQ ID NO: 3315)

TCGCTGCACTGTGAAGCT      (SEQ ID NO: 3316)

CCTCTGCACTGTGAAGCT.     (SEQ ID NO: 3317)
```

Referring to Amp Plot and Dissociation curves on a display of 5700 software, it was found that probes 62, 12, and 152 were amplified. Therefore, it was identified as DRB1*040502 and DRB1*130202 referring to the allele-probe list 1 (Tables 23-1 to 23-13).

Example 12

Extraction of DNA from 1 ml of human blood was performed in the same way as in Example 3. PCR of human HLA-DRB exon 2 was then performed in the same manner as in Example 2 except that 6 µl of the mixed primer consisting of 1 µl each of the solutions containing the following sequences at 10 pmol/µl respectively, and 9 µl of ultra pure water were used:

```
CCGGATCCTTCGTGTCCCCACAGCACG  (SEQ ID NO: 3318)

AACCCCGTAGTTGTGTCTGCA        (SEQ ID NO: 3319)

AGAGTACTCCAAGAAACGTG         (SEQ ID NO: 3314)

CCGCTGCACCGTGAAGCT           (SEQ ID NO: 3315)

TCGCTGCACTGTGAAGCT           (SEQ ID NO: 3316)

CCTCTGCACTGTGAAGCT.          (SEQ ID NO: 3317)
```

At the same time, a DNA microarray was prepared to identify the allele in the specimen described above in the same manner as in Example 2, except that probes in the probe list of Tables 22-1 to 22-7 were used to form the probe spots respectively.

Then, hybridization was performed using the above specimen and the prepared DNA microarray in the same manner as in Example 2. The fluorometry measurement was conducted with GenePix4000B (Axon).

As a result it was found that probes 59, 133, and 134 were amplified. Therefore, it was identified as DRB1*040502 and DRB1*130202 referring to the allele-probe list 1 (Tables 24-1 to 24-13).

```
Allele list
DRB1*010101:
                                                            (SEQ ID NO: 2493)
atggtgtgtctgaagctccctggaggctcctgcatgacagcgctgacagtgacactgatggtgctgagctccccac tggctttggctggggacacccgaccacgtttcttgtggcagcttaagtttgaatgtcatttcttcaatgggacgga gcgggtgcggttgctggaAagaTgcatctataaccaagaggagtCcgtgcgcttcgacagcgacgtgggggagtac cgggcggtgacggagctggggcggcctgaTgcCgagtactggaacagccagaaggacctcctggagcagaggcggg ccgcggtggacacctactgcagacacaactacggggttgGtgagagcttcacagtgcagcggcgag;

DRB1*010102:
                                                            (SEQ ID NO: 2494)
cacgtttcttgtggcagcttaagtttgaatgtcatttcttcaatgggacggagcgggtgcggttgctggaaagatg catctataaccaagaggaAtccgtgcgcttcgacagcgacgtgggggagtaccgggcggtgacggagctggggcgg cctgatgccgagtactggaacagccagaaggacctcctggagcagaggcgggccgcggtggacacctactgcagac acaactacggggttggtgagagcttcacagtgcagcggcgag;

DRB1*010201:
                                                            (SEQ ID NO: 2495)
ggggacacccgaccacgtttcttgtggcagcttaagtttgaatgtcatttcttcaatgggacggagcgggtgcggt tgctggaaagatgcatctataaccaagaggagtccgtgcgcttcgacagcgacgtgggggagtaccgggcggtgac ggagctggggcggcctgatgccgagtactggaacagccagaaggacctcctggagcagaggcgggccgcggtggac acctaTtgcagacacaactacggggCtgtggagagcttcacagtgcagcggcgag;

DRB1*010202:
                                                            (SEQ ID NO: 2496)
cacgtttcttgtggcagcttaagtttgaatgtcatttcttcaatgggacggagcgggtgcggttgctggaaagatg catctataaccaagaggagtccgtgcgcttcgacagcgacgtgggggagtaccgggcggtgacggagctggggcgg cctgatgccgagtactggaacagccagaaggacctcctggagcagaggcgggccgcCgtggacacctattgcagac acaactacggggctgtgg;
```

DRB1*0103:

(SEQ ID NO: 2497)

atggtgtgtctgaagctccctggaggctcctgcatgacagcgctgacagtgacactgatggtgctgagctccccac tggctttggctggggacacccgaccacgtttcttgtggcagcttaagtttgaatgtcatttcttcaatgggacgga gcgggtgcggttgctggaaagatgcatctataaccaagaggagtccgtgcgcttcgacagcgacgtggggagtac cgggcggtgacggagagctggggcggcctgatgccgagtactggaacagccagaaggacAtcctggaagacGAgcggg ccgcggtggacacctactgcagacacaactacggggttggtgagagcttcacagtgcagcggcgag;

DRB1*0104:

(SEQ ID NO: 2498)

ggggacacccgaccacgtttcttgtggcagcttaagtttgaatgtcatttcttcaatgggacggagcgggtgcggt tgctggaaagatgcatctataaccaagaggagtccgtgcgcttcgacagcgacgtgggggagtaccgggcggtgac ggagctggggcggcctgatgccgagtactggaacagccagaaggacctcctggagcagaggcgggccgcggtggac aaTtactgcagacacaactacggggttgtGgagagcttcacagtgcagcggcgag;

DRB1*0105:

(SEQ ID NO: 2499)

cacgtttcttgtggcagcttaagtttgaatgtcatttcttcaatgggacggagcgggtgcggttgctggaaagatg catctataaccaagaggagtccgtgcgcttcgacagcgacgtgAgggagtaccgggcggtgacggagctggggcgg cctgatgccgagtactggaacagccagaaggacctcctggagcagaggcgggccgcggtggacacctactgcagac acaactacggggttggtgagagcttcacagtgcagcggcgag;

DRB1*0106:

(SEQ ID NO: 2500)

cacgtttcttgtggcagcttaagtttgaatgtcatttcttcaatgggacggagcgggtgcggttgctggaaagatg catctataaccaagaggagtccgtgcgcttcgacagcgacgtgggggagtaccgggcggtgacggagctggggcgg cctgatgccgagtactggaacagccagaaggacctcctggagcaggCgcgggccgcggtggacacctactgcagac acaactacggggttgtGgagagcttcacagtgcagcggcgag;

DRB1*0107:

(SEQ ID NO: 2501)

cacgtttcttgtggGagcttaagtttgaatgtcatttcttcaatgggacggagcgggtgcggttgctggaaagatg catctataaccaagaggagtccgtgcgcttcgacagcgacgtgggggagtaccgggcggtgacggagctggggcgg cctgatgccgagtactggaacagccagaaggacctcctggagcagaggcgggccgcggtggacacctactgcagac acaactacggggttggtgagagcttcacagtgcagcggcgag;

DRB1*0108:

(SEQ ID NO: 2502)

cacgtttcttgtggcagcttaagtttgaatgtcatttcttcaatgggacggagcgggtgcggttgctggaaagatg catctataaccaagaggagtAcgtgcgcttcgacagcgacgtgggggagtaccgggcggtgacggagctggggcgg cctgatgccgagtactggaacagccagaaggacctcctggagcagaggcgggccgcggtggacacctactgcagac acaactacggggttggtgagagcttcacagtgcagcggcgag;

DRB1*0109:

(SEQ ID NO: 2503)

cacgtttcttgtggcagcttaagtttgaatgtcatttcttcaatgggacggagcgggtgcggttgctggaaagatg catctataaccaagaggagtccgtgcgcttcgacagcgacgtgggggagtaccgggcggtgacggagctggggcgg cctgatgccgagtactggaacagccagaaggacctcctggagcagGCgcgggccgcggtggacacctactgcagac acaactacggggttggtgagagcttcacagtgcagcggcgag;

DRB1*0110:

(SEQ ID NO: 2504)

cacgtttcttgtggcagcttaagtttgaatgtcatttcttcaatgggacggagcgggtgcggttgctggaaagatg catctataaccaagaggagtccgtgcgcttcgacagcgacgtgggggagtaccgggcggtgacggagctggggcgg cctgatgccgagtactggaacagccagaaggacctcctggagcagaAgcgggccgcggtggacacctactgcagac acaactacggggttggtgagagcttcacagtgcagcggcgag;

DRB1*030101:
(SEQ ID NO: 2505)
ggggacaccagaccacgtttcttggagtactctacgtctgagtgtcatttcttcaatgggacggagcgggtgcggt AcctggacagatacttcCataaccaggaggagAAcgtgcgcttcgacagcgacgtgggggagtTccgggcggtgac ggagctggggcggcctgatgccgagtactggaacagccagaaggacctcctggagcagaagcggggccGggtggac aActactgcagacacaactacggggttgtGgagagcttcacagtgcagcggcgag;

DRB1*030102:
(SEQ ID NO: 2506)
cacgtttcttggagtactctacgtctgagtgtcatttcttcaatgggacggagcgggtgcggtacctggacagata cttccataaccaggaggagaacgtgcgcttcgacagcgacgtgggggagttccgggcggtgacggagctggggcgg cctgatgccgagtactggaacagccagaaggacctcctggagcagaagcggggccGgtggacaaTtactgcagac acaactacggggttgtGgagagcttcacagtgcagcg;

DRB1*030201:
(SEQ ID NO: 2507)
ggggacaccagaccacgtttcttggAgtactctacgtctgagtgtcatttcttcaatgggacggagcgggtgcggt tcctggaGagatacttcCataaccaggaggagAAcgtgcgcttcgacagcgacgtgggggagtaccgggcggtgac ggagctggggcggcctgatgccgagtactggaacagccagaaggacctcctggagcagaagcggggccGggtggac aActactgcagacacaactacggggttggtgagagcttcacagtgcagcggcgag;

DRB1*030202:
(SEQ ID NO: 2508)
ggggacaccagaccacgtttcttggagtactctacgtctgagtgtcatttcttcaatgggacggagcgggtgcggt tcctggaGagatacttccataaccaggaggagAAcgtgcgcttcgacagcgacgtgggggagtaccgggcggtgac ggagctggggcggcctgatgccgagtactggaacagccagaaggacctcctggagcagaagcggggccGggtggac aaTtactgcagacacaactacggggttggtgagagcttcacagtgcagcggcgag;

DRB1*0303:
(SEQ ID NO: 2509)
tactctacgtctgagtgtcatttcttcaatgggacggagcgggtgcggttcctggaGagatacttcCataaccagg aggagAAcgtgcgcttcgacagcgacgtgggggagtaccgggcggtgacggagctggggcggcctgatgccgagta ctggaacagccagaaggacctcctggagcagaagcggggccGggtggacaActactgcagacacaactacggggtt gtGgagagcttcacagtgcagcggcga;

DRB1*0304:
(SEQ ID NO: 2510)
cacgtttcttggagtactctacgtctgagtgtcatttcttcaatgggacggagcgggtgcggtAcctggacagata cttcCataaccaGgaggagtccgtgcgcttcgacagcgacgtgggggagtTccgggcggtgacggagctggggcgg cctgatgccgagtactggaacagccagaaggacctcctggagcagaagcggggccGgtggacaActactgcagac acaactacggggttgtGgagagcttcacagtgcagcggcgag;

DRB1*030501:
(SEQ ID NO: 2511)
cacgtttcttggagtactctacgtctgagtgtcatttcttcaatgggacggagcgggtgcggtAcctggacagata cttcCataaccaggaggagAAcgtgcgcttcgacagcgacgtgggggagtTccgggcggtgacggagctggggcgg cctgatgccgagtactggaacagccagaaggacctcctggagcagaagcggggccGgtggacaActactgcagac acaactacggggttggtgagagcttcacagtgcagcggcgag;

DRB1*030502:
(SEQ ID NO: 2512)
cacgtttcttggagtactctacgtctgagtgtcatttcttcaatgggacggagcgggtgcggtacctggacagata cttccataaccaggaggagaacgtgcgcttcgacagcgacgtgggggagttccgggcggtgacggagctggggcgg cctgatgccgagtactggaacagccagaaggacctcctggagcagaagcggggccgggtggacaActactgcagac acaactacggggttggtgagagcttcacGgtgcagcggcgag;

DRB1*0306:
(SEQ ID NO: 2513)
ttcttggagtactctacgtctgagtgtcatttcttcaatgggacggagcgggtgcggtAcctggaCagatacttcC ataaccaggaggagAAcgtgcgcttcgacagcgacgtgggggagtaccgggcggtgacggagctggggcggcctga tgccgagtactggaacagccagaaggacctcctggagcagaagcggggccGgtggacaActactgcagacacaac tacggggttgtGgagagcttcacagtgcag;

DRB1*0307:
(SEQ ID NO: 2514)
ggggacaccagaccacgtttcttggagtactctacgtctgagtgtcatttcttcaatgggacggagcgggtgcggt tcctggacagatacttcCataaccaggaggagAAcgtgcgcttcgacagcgacgtgggggagtTccgggcggtgac ggagctggggcggcctgatgccgagtactggaacagccagaaggacctcctggagcagaagcggggccGgtggac aActactgcagacacaactacggggttgtGgagagcttcacagtgcagcggcgag;

DRB1*0308:
(SEQ ID NO: 2515)
ggggacaccagaccacgtttcttggagtactctacgtctgagtgtcatttcttcaatgggacggagcgggtgcggt acctggacagatacttccataaccaggaggagAacgtgcgcttcgacagcgacgtgggggagttccgggcggtgac ggagctggggcggcctgatgAGgagtactggaacagccagaaggacctcctggagcagaagcggggccGgtggac aActactgcagacacaactacggggttgtGgagagcttcacagtgcagcggcgag;

DRB1*0309:
(SEQ ID NO: 2516)
ttggagtactctacgtctgagtgtcatttcttcaatgggacggagcgggtgcggtacctggacagatacttccata accGggaggagaacgtgcgcttcgacagcgacgtgggggagttccgggcggtgacggagctggggcggcctgatgc cgagtactggaacagccagaaggacctcctggagcagaagcggggccgggtggacaactactgcagacacaactac ggggttggtgagagcttcacagtgcagcgg;

DRB1*0310:
(SEQ ID NO: 2517)
ggggacaccagaccacgtttcttggagtactctacgtctgagtgtcatttcttcaatgggacggagcgggtgcggt acctggacagatacttccataaccaggaggagaacgtgcgcttcgacagcgacgtgggggagttccgggcggtgac ggagctggggcggcctgCtgcggagcactggaacagccagaaggacctcctggagcagaagcggggccGgtggac aActactgcagacacaactacggggttgtGgagagcttcacagtgcagcggcgag;

DRB1*0311:
(SEQ ID NO: 2518)
cacgtttcttggagtactctacgtctgagtgtcatttcttcaatgggacggagcgggtgcggtAcctggacagata cttccataaccaggaggagaacgtgcgcttcgacagcgacgtgggggagttccgggcggtgacggagctggggcgg cctgatgccgagtactggaacagccagaaggacctcctggagcagaagcggggcCAggtggacaActactgcagac acaactacggggttgtGgagagcttcacagtgcagcggcga;

DRB1*0312:
(SEQ ID NO: 2519)
ttggagtactctacgtctgagtgtcatttcttcaatgggacggagcgggtgcggtacctggacagatacttccata accaggaggagaacgtgcgcttcgacagcgacgtgggggagttccgggcggtgacggagctggggcggcctagCgc cgagtactggaacagccagaaggacctcctggagcagaagcggggccGgtggacaActactgcagacacaactac ggggttgtGgag;

DRB1*0313:
(SEQ ID NO: 2520)
cacgtttcttggagtactctacgtctgagtgtcatttcttcaatgggacggagcgggtgcggtacctggacagata cttccataaccaggaggagaacgtgcgcttcgacagcgacgtgggggagttccgggcggtgacggagctggggcgg

```
cctgatgccgagtCctggaacagccagaaggacctcctggagcagaagcggggccGgtggacaActactgcagac
acaactacggggttgtGgagagcttcacagtgcagcggcgag;
```

DRB1*0314:

(SEQ ID NO: 2521)

```
cacgtttcttggagtactctacgtctgagtgtcatttcttcaatgggacggagcgggtgcggtAcctggacagata
cttcCataaccaggaggagAAcgtgcgcttcgacagcgacgtgggggagtTccgggcggtgacggagctggggcgg
cctgatgccgagtactggaacagccagaaggacctcctggagcagaagcggggccGgtggacacctactgcagac
acaactacggggttggtgagagcttcacagtgcagcggcgag;
```

DRB1*0315:

(SEQ ID NO: 2522)

```
cacgtttcttggagtactctacgtctgagtgtcatttcttcaatgggacggagcgggtgcggtAcctggacagata
cttcCataaccaggaggagAAcgtgcgcttcgacagcgacgtgggggagtTccgggcggtgacggagctggggcgg
cctgatgccgagtactggaacagccagaaggacctcctggagcagaagcggggccGgtggacacctactgcagac
acaactacggggttgtGgagagcttcacagtgcagcggcga;
```

DRB1*0316:

(SEQ ID NO: 2523)

```
cacgtttcttggagtactctacgtctgagtgtcatttcttcaatgggacggagcgggtgcggtacctggacagata
cttccataaccaggaggagaacgtgcgcttcgacagcgacgtgggggagttcTgggcggtgacggagctggggcgg
cctgatgccgagtactggaacagccagaaggacctcctggagcagaagcggggccgggtggacaactactgcagac
acaactacggggttgtg;
```

DRB1*0317:

(SEQ ID NO: 2524)

```
cacgtttcttggagtactctaCgtctgagtgtcatttcttcaatgggacggagcgggtgcggttcctggaCagata
cttctataaccaagaggagtAcgtgcgcttcgacagcgacgtgggggagtaccgggcggtgaGgagctggggcgg
cctgatgccgagtactggaacagccagaaggacctcctggagcagaagcggggccaggtggacaaTtactgcagac
acaactacggggttggtgagagcttcacagtgcagcggcgag;
```

DRB1*0318:

(SEQ ID NO: 2525)

```
cacgtttcttggagtactctacgtctgagtgtcatttcttcaatgggacggagcgggtgcggtacctggacagata
cttccataaccaggaggagaacgtgcgcttcgacagcgacgtgCggggagttccgggcggtgacggagctggggcgg
cctgatgccgagtactggaacagccagaaggacctcctggagcagaagcggggccgggtggacaactactgcagac
acaactacggggttgtGgagagcttcacagtgcagcggcgag;
```

DRB1*0319:

(SEQ ID NO: 2526)

```
cacgtttcttggagtactctacgtctgagtgtcatttcttcaatgggacggagcgggtgcggtacctggacagata
cttccataaccaggaggagaacgtgcgcttcgacagcgacgtgggggagttccgggcggtgacggagctggggcgg
cctgatgccgagtactggaacagccagaaggacAtcctggagcagaagcggggccGgtggacaActactgcagac
acaactacggggttgtGgagagcttcacagtgcagcggcgag;
```

DRB1*0320:

(SEQ ID NO: 2527)

```
cacgtttcttggagtactctacgtctgagtgtcatttcttcaatgggacggagcgggtgcggtacctggacagata
cttccataaccaggaggagaacgtgcgcttcgacagcgacgtgggggagttccgggcggtgacggagctggggcgg
cctgatgccgagtactggaacagccagaaggacctcctggagcagaagcggggccgggtggacaActactgcagac
acaactacggggCtgtggagagcttcacagtgcagcgg;
```

DRB1*0321:

(SEQ ID NO: 2528)

```
cgtttcttggagtactctacgtctgagtgtcatttcttcaatgggacggagcgggtgcggttcctggacagatact
tccataaccaggaggagtTcgtgcgcttcgacagcgacgtgggggagtTccgggcggtgacggagctggggcggcc
``` tgatgccgagtactggaacagccagaaggacctcctggagcagaagcggggccGgtggacaActactgcagacac aactacggggttgtGgagagcttcacagtgcagcggcga

DRB1*0322:

(SEQ ID NO: 2529)

tttcttggagtactctacgtctgagtgtcatttcttcaatgggacggagcgggtgcggtacctggacagatacttc

Gataaccaggaggagaacgtgcgcttcgacagcgacgtgggggagttccgggcggtgacggagctggggcggcctg atgccgagtactggaacagccagaaggacctcctggagcagaagcggggccgggtggacaactactgcagacacaa ctacggggttgtggagagcttcacagtgcagcggcgag;

DRB1*0323:

(SEQ ID NO: 2530)

cacgtttcttggagtactctacgtctgagtgtcatttcttcaatgggacggagcgggtgcggtacctggacagata cttccataaccGggaggagaacgtgcgcttcgacagcgacgtgggggagttccgggcggtgacggagctggggcgg cctgatgccgagtactggaacagccagaaggacctcctggagcagaagcggggccgggtggacaactactgcagac acaactacggggttgtGgagagcttcacagtgcagcggcgag;

DRB1*0324:

(SEQ ID NO: 2531)

cacgtttcttggagtactctacgtctgagtgtcatttcttcaatgggacggagcgggtgcggttcctggacagata cttccataaccaggaggagaacgtgcgcttcgacagcgacgtgggggagtTccgggcggtgacggagctggggcgg cctgatgccgagtactggaacagccagaaggacctcctggagcagaagcggggcCAggtggacaaTtactgcagac acaactacggggttgtGgagagcttcacagtgcagcggcgag;

DRB1*0325:

(SEQ ID NO: 2532)

cacgtttcttggagtactctacgtctgagtgtcatttcttcaatgggacggagcgggtgcggtAcctggacagata cttcCataaccaGgaggagtAcgtgcgcttcgacagcgacgtgggggagtTccgggcggtgacggagctggggcgg cctgatgccgagtactggaacagccagaaggacctcctggagcagaagcggggccGgtggacaActactgcagac acaactacggggttgtGgagagcttcacagtgcagcggcgag;

DRB1*040101:

(SEQ ID NO: 2533)

atggtgtgtctgaagTtccctggaggctcctgcatggcagctctgacagtgacactgatggtgctgagctccccac tggctttggctggggacacccgaccacgtttcttggagcaggttaaacatgagtgtcatttcttcaacgggacgga gcgggtgcggttcctggacagatacttctatcaccaagaggagtacgtgcgcttcgacagcgacgtgggggagtac cgggcggtgacggagctggggcggcctgatgccgagtactggaacagccagaaggacctcctggagcagaAgcggg ccgcggtggacacctactgcagacacaactacggggttggtgagagcttcacagtgcagcggcgag;

DRB1*040102:

(SEQ ID NO: 2534)

cacgtttcttggagcaggttaaacatgagtgtcatttcttcaacgggacggagcgggtgcggttcctggacagata cttctatcaccaagaAgagtacgtgcgcttcgacagcgacgtgggggagtaccgggcggtgacggagctggggcgg cctgatgccgagtactggaacagccagaaggacctcctggagcagaagcgggccgcggtggacacctactgcagac acaactacggggttggtgagagcttcacagtgcagcggcgag;

DRB1*0402:

(SEQ ID NO: 2535)

atggtgtgtctgaagTtccctggaggctcctgcatggcagctctgacagtgacactgatggtgctgagctccccac tggctttggctggggacacccgaccacgtttcttggagcaggttaaacatgagtgtcatttcttcaacgggacgga gcgggtgcggttcctggacagatacttctatcaccaagaggagtacgtgcgcttcgacagcgacgtgggggagtac cgggcggtgacggagctggggcggcctgatgccgagtactggaacagccagaaggacatcctggaagacgAgcggg ccgcggtggacacctactgcagacacaactacggggttgtGgagagcttcacagtgcagcggcgag;

DRB1*040301:

(SEQ ID NO: 2536)
ggggacacccgaccacgtttcttggagcaggttaaaCatgagtgtcatttcttcaacgggacggagcgggtgcggt
tcctggacagatacttctatcaccaagaggagtAcgtgcgcttcgacagcgacgtgggggagtaccgggcggtgac
ggagctggggcggcctgatgccgagtactggaacagccagaaggacctcctggagcagaggcgggccgAggtggac
acctactgcagacacaactacggggttgtGgagagcttcacagtgcagcggcgag;

DRB1*040302:

(SEQ ID NO: 2537)
cacgtttcttggagcaggttaaaCatgagtgtcatttcttcaacgggacggagcgggtgcggttcctggacagata
cttctatcaccaagaggagtacgtgcgcttcgacagcgacgtgggggagtaccgggcggtgacggagctggggcgg
cctgacgcTgagtactggaacagccagaaggacctcctggagcagaggcgggccgAggtggacacctactgcagac
acaactacggggttgtGgagagcttcacagtgcagcggcgag;

DRB1*0404:

(SEQ ID NO: 2538)
atggtgtgtctgaagTtccctggaggctcctgcatggcagctctgacagtgacactgatggtgctgagctccccac
tggctttggctggggacacccgaccacgtttcttggagcaggttaaacatgagtgtcatttcttcaacgggacgga
gcgggtgcggttcctggacagatacttctatcaccaagaggagtacgtgcgcttcgacagcgacgtgggggagtac
cgggcggtgacggagctggggcggcctgatgccgagtactggaacagccagaaggacctcctggagcagaggcggg
ccgcggtggacacctactgcagacacaactacggggttgtGgagagcttcacagtgcagcggcgag;

DRB1*040501:

(SEQ ID NO: 2539)
ggggacacccgaccacgtttcttggagcaggttaaaCAtgagtgtcatttcttcaacgggacggagcgggtgcggt
tcctggacagatacttctatCaccaagaggagtAcgtgcgcttcgacagcgacgtgggggagtaccgggcggtgac
ggagctggggcggcctaGcgccgagtactggaacagccagaaggacctcctggagcagaggcgggccgcggtggac
acctactgcagacacaactacggggttggtgagagcttcacagtgcagcggcga;

DRB1*040502:

(SEQ ID NO: 2540)
cacgtttcttggagcaggttaaacatgagtgtcatttcttcaacgggacggagcgggtgcggttcctggacagata
cttctatcaccaagaggagtacgtgcgGttcgacagcgacgtgggggagtaccgggcggtgacggagctggggcgg
cctagcgccgagtactggaacagccagaaggacctcctggagcagaggcgggccgcggtggacacctactgcagac
acaactacggggttggtgagagcttcacagtgcagcggcgag;

DRB1*040503:

(SEQ ID NO: 2541)
cacgtttcttggagcaggttaaacatgagtgtcatttcttcaacgggacggagcgggtgcggttcctggacagata
cttctatcaccaagaggagtacgtgcgcttcgacagcgacgtgggggagtaccgggcggtgacggagctggggcgg
cctagcgccgagtactggaacagccagaaggacctcctggagcagaggcgggccgcggtggacacctactgcagac
acaactacggggttggtgagagcttcacagtgcagcgAcgag;

DRB1*040504:

(SEQ ID NO: 2542)
cacgtttcttggagcaggttaaacatgagtgtcatttcttcaacgggacggagcgggtgcggttcctggacagata
cttctatCaccaagaggagtacgtgcgcttcgacagcgacgtgggggagtaccgggcggtgacggagctggggcgg
cctagCgccgagtactggaacagccagaaggacctcctggagcagaggcgggccgcggtggacacctactgcagac
acaactacggggttggtgagagcttcacGgtgcagcggcgag;

DRB1*0406:

(SEQ ID NO: 2543)
ggggacacccgaccacgtttcttggagcaggttaaaCatgagtgtcatttcttcaacgggacggagcgggtgcggt
tcctggacagatacttctatCaccaagaggagtccgtgcgcttcgacagcgacgtgggggagtaccgggcggtgac ggagctggggcggcctgatgccgagtactggaacagccagaaggacctcctggagcagaggcgggccgAggtggac
acctactgcagacacaactacggggttgtGgagagcttcacagtgcagcggcgag;

DRB1*040701:

(SEQ ID NO: 2544)

ggggacacccgaccacgtttcttggagcaggttaaaCatgagtgtcatttcttcaacgggacggagcgggtgcggt
tcctggacagatacttctatcaccaagaggagtAcgtgcgcttcgacagcgacgtgggggagtaccgggcggtgac
ggagctggggcggcctgatgccgagtactggaacagccagaaggacctcctggagcagaggcgggccgAggtggac
acctactgcagacacaactacggggttggtgagagcttcacagtgcagcggcga;

DRB1*040702:

(SEQ ID NO: 2545)

cacgtttcttggagcaggttaaacatgagtgtcatttcttcaacgggacggagcgggtgcggttcctggacagata
cttctatcaccaagaggagtacgtgcgcttcgacagcgacgtgggggagtaccgggcggtgacggagctggggcgg
cctgatgccgagtactggaacagccagaaggacctcctggagcagagAcgggccgaggtggacacctactgcagac
acaactacggggttggtgagagcttcacagtgcagcgg;

DRB1*0408:

(SEQ ID NO: 2546)

tttcttggagcaggttaaACAtgagtgtcatttcttcaacgggacggagcgggtgcggttcctggacagatacttc
tatCaccaagaggagtAcgtgcgcttcgacagcgacgtgggggagtaccgggcggtgacggagctggggcggcctg
atgccgagtactggaacagccagaaggacctcctggagcagaggcgggccgcggtggacacctactgcagacacaa
ctacggggttggtgagagcttcacagtgcagcggcgag;

DRB1*0409:

(SEQ ID NO: 2547)

tgagtgtcatttcttcaacgggacggagcgggtgcggttcctggacagatacttctatCaccaagaggagtacgtg
cgcttcgacagcgacgtgggggagtaccgggcggtgacggagctggggcggcctaGcgccgagtactggaacagcc
agaaggacctcctggagcagaAgcgggccgcggtggacacctactgcagacacaactacggggttggtgagag;

DRB1*0410:

(SEQ ID NO: 2548)

tttcttggagcaggttaaacatgagtgtcatttcttcaacgggacggagcgggtgcggttcctggacagatacttc
tatCaccaagaggagtAcgtgcgcttcgacagcgacgtgggggagtaccgggcggtgacggagctggggcggccta
Gcgccgagtactggaacagccagaaggacctcctggagcagaggcgggccgcggtggacacctactgcagacacaa
ctacggggttgtGgagagcttcacagtgcagcggcgag;

DRB1*0411:

(SEQ ID NO: 2549)

atggtgtgtctgaagTtccctggaggctcctgcatggcagctctgacagtgacactgatggtgctgagctccccac
tggctttggctggggacacccgaccacgtttcttggagcaggttaaacatgagtgtcatttcttcaacgggacgga
gcgggtgcggttcctggacagatacttctatcaccaagaggagtacgtgcgcttcgacagcgacgtgggggagtac
cgggcggtgacggagctggggcggcctagcgccgagtactggaacagccagaaggacctcctggagcagaggcggg
ccgAggtggacacctactgcagacacaactacggggttgtGgagagcttcacagtgcagcggcgag;

DRB1*0412:

(SEQ ID NO: 2550)

ttcttggagcaggttaaacatgagtgtcatttcttcaacgggacggagcgggtgcggttcctggacagatacttct
atCaccaagaggagtacgtgcgcttcgacagcgacgtgggggagtaccgggcggtgacggagctggggcggcctaG
cgccgagtactggaacagccagaaggacAtcctggaagacaggcgggcccTggtggacacctactgcagacacaac
tacggggttgtGgagagcttcacagtgcagcgg;

DRB1*0413:

(SEQ ID NO: 2551)

catgagtgtcatttcttcaacgggacggagcgggtgcggttcctggacagatacttctatCaccaagaggagtacg
tgcgcttcgacagcgacgtgggggagtaccgggcggtgacggagctggggcggcctgatgccgagtactggaacag -continued ccagaaggacctcctggagcagaAgcgggccgcggtggacacctactgcagacacaactacggggttgtGgagagc ttcaca;

DRB1*0414:

(SEQ ID NO: 2552)
tgagtgtcatttcttcaacgggacggagcgggtgcggttcctggacagatacttctatCaccaagaggagtacgtg cgcttcgacagcgacgtgggggagtaccgggcggtgacggagctggggcggcctgatgccgagtactggaacagcc agaaggacAtcctggaagacGAgcgggccgcggtggacacctactgcagacacaactacggggttggtgagag;

DRB1*0415:

(SEQ ID NO: 2553)
cacgtttcttggagcaggttaaaCatgagtgtcatttcttcaacgggacggagcgggtgcggttcctggacagata cttctatcaccaagaggagtacgtgcgcttcgacagcgacgtgggggagtaccgggcggtgacggagctggggcgg cctgatgaGgagtactggaacagccagaaggacTtcctggaagaCaggcgggccgcggtggacacctactgcagac acaactacggggttgtGgagag;

DRB1*0416:

(SEQ ID NO: 2554)
atgagtgtcatttcttcaacgggacggagcgggtgcggttcctggacagatacttctatcaccaagaggagtacgt gcgcttcgacagcgacgtgggggagtaccgggcggtgacggagctggggcggcctgatgccCagtactggaacagc cagaaggacctcctggagcagaagcgggccgcggtggacacctactgcagacacaactacggggttggtg;

DRB1*0417:

(SEQ ID NO: 2555)
atgagtgtcatttcttcaacgggacggagcgggtgcggttcctggacagatacttctatCaccaagaggagtacgt gcgcttcgacagcgacgtgggggagtaccgggcggtgacggagctggggcggcctaGcgccgagtactggaacagc cagaaggacctcctggagcagaggcgggccgAggtggacacctactgcagacacaactacggggttggt;

DRB1*0418:

(SEQ ID NO: 2556)
atgagtgtcatttcttcaacgggacggagcgggtgcggttcctggacagatacttctatCaccaagaggagtacgt gcgcttcgacagcgacgtgggggagtaccgggcggtgacggagctggggcggcctgatgccgagtactggaacagc cagaaggacAtcctggaagacaggcgggcccTggtggacacctactgcagacacaactacggggttgtGgagagct tcacagtgca;

DRB1*0419:

(SEQ ID NO: 2557)
tttcttggagcaggttaaACAtgagtgtcatttcttcaacgggacggagcgggtgcggttcctggacagatacttc tatCaccaagaggagtccgtgcgcttcgacagcgacgtgggggagtaccgggcggtgacggagctggggcggcctg atgccgagtactggaacagccagaaggacctcctggagcagaggcgggccgcggtggacacctactgcagacacaa ctacggggttggtgagagcttcacagtgcagcggcgag;

DRB1*0420:

(SEQ ID NO: 2558)
atgagtgtcatttcttcaacgggacggagcgggtgcggttcctggacagatacttctatCaccaagaggagtccgt gcgcttcgacagcgacgtgggggagtaccgggcggtgacggagctggggcggcctgatgccgagtactggaacagc cagaaggacctcctggagcagaggcgggccgAggtggacacctactgcagacacaactacggggttggtg;

DRB1*0421:

(SEQ ID NO: 2559)
gagcaggttaaacatgagtgtcatttcttcaacgggacggagcgggtgcggttcctggacagatacttctatCacc aagaggagtccgtgcgcttcgacagcgacgtgggggagtaccgggcggtgacggagctggggcggcctgatgccga gtactggaacagccagaaggacctcctggagcagaAgcgggccgcggtggacacctactgcagacacaactacggg gttggtgagagcttcacagtg;

DRB1*0422:

(SEQ ID NO: 2560)
gagcaggttaaacatgagtgtcatttcttcaacgggacggagcgggtgcggttcctggacagatacttctatCacc aagaggagtAcgtgcgcttcgacagcgacgtgggggagtaccgggcggtgacggagctggggcggcctgatgccga gtactggaacagccagaaggacctcctggagcagaagcggggccGggtggacaActactgcagacacaactacggg gttgtGgagagcttcaca;

DRB1*0423:
(SEQ ID NO: 2561)
cacgtttcttggagcaggttaaacatgagtgtcatttcttcaacgggacggagcgggtgcggttcctggacagata cttctatcaccaagaggagtacgtgcgcttcgacagcgacgtgggggagtaccgggcggtgacggagctggggcgg cctgatgccgagtactggaacagccagaaggacctcctggagcagaggcgggccgcggtggacacctactgcagac acaactacggggttgtggagagAttcacagtgcagcggcgag;

DRB1*0424:
(SEQ ID NO: 2562)
cacgtttcttggagcaggttaaacatgagtgtcatttcttcaacgggacggagcgggtgcggttcctggacagata cttctatcaccaagaggagtacgtgcgcttcgacagcgacgtgggggagtaccgggcggtgacggagctggggcgg cctaGCgccgagtactggaacagccagaaggacctcctggagcGgaggcgggccgcggtggacacctactgcagac acaactacggggttggtgagagcttcacagtgcagcggcgag;

DRB1*0425:
(SEQ ID NO: 2563)
ttggagcaggttaaacatgagtgtcatttcttcaacgggacggagcgggtgcggttcctggacagatacttctatC accaagaggagtAcgtgcgcttcgacagcgacgtgggggagtaccgggcggtgacggagctggggcggcctgatgc cgagtactggaacagccagaaggacTtcctggaagacaggcgggcccTggtggacacctactgcagacacaactac ggggttgtGgagag;

DRB1*0426:
(SEQ ID NO: 2564)
cacgtttcttggagcaggttaaacatgagtgtcatttcttcaacgggacggagcgggtgcggttcctggacagata cttctatcaccaagaggagtacgtgcgcttcgacagcgacgtgggggagtaccgggcggtgacggagctggggcgg cctgatAccgagtactggaacagccagaaggacctcctggagcagaagcgggccgcggtggacacctactgcagac acaactacggggttggtg;

DRB1*0427:
(SEQ ID NO: 2565)
cacgtttcttggagcaggttaaacatgagtgtcatttcttcaacgggacggagcgggtgcggttcctggacagata cttctatcaccaagaggagtAcgtgcgcttcgacagcgacgtgggggagtaccgggcggtgacggagctggggcgg cctgatgccgagtactggaacagccagaaggacctcctggagcagaggcgggccgAggtggacacctactgcagac acaactacggggCtgtggagagcttcacagtg;

DRB1*0428:
(SEQ ID NO: 2566)
cacgtttcttggagcaggttaaacatgagtgtcatttcttcaacgggacggagcgggtgcggttcctggacagata cttctatCaccaagaggagtAcgtgcgcttcgacagcgacgtgggggagtTccgggcggtgacggagctggggcgg cctaGcgccgagtactggaacagccagaaggacctcctggagcagaggcgggccgcggtggacacctactgcagac acaactacggggttggtgagagcttcacagtgcagcggcgag;

DRB1*0429:
(SEQ ID NO: 2567)
cacgtttcttggagcaggttaaacatgagtgtcatttcttcaacgggacggagcgggtgcggttcctggacagata cttctatcaccaagaggagtacgtgcgcttcgacagcgacgtgggggagtaccgggcggtgaTggagctggggcgg cctagcgccgagtactggaacagccagaaggacctcctggagcagaggcgggccgcggtggacacctactgcagac acaactacggggttggtgagagcttcacagtgcagcggcgag;

DRB1*0430:
(SEQ ID NO: 2568)
cacgtttcttggagcaggttaaacatgagtgtcatttcttcaacgggacggagcgggtgcggttcctggacagata cttctatcaccaagaggagtacgtgcgcttcgacagcgacgtgggggagtacgggTggtgacggagctggggcgg -continued cctagcgccgagtactggaacagccagaaggacctcctggagcagaggcgggccgcggtggacacctactgcagac acaactacggggttggtgagagcttcacagtgcagcggcgag;

DRB1*0431:
(SEQ ID NO: 2569)
cacgtttcttggagcaggttaaaCatgagtgtcatttcttcaacgggacggagcgggtgcggttcctggacagata cttctatCaccaagaggagtAcgtgcgcttcgacagcgacgtgggggagtaccgggcggtgacggagctggggcgg cctgatgccgagtactggaacagccagaaggacctcctggagcagaggcgggccCTggtggacacctactgcagac acaactacggggttggtgagagcttcacagtgcagcggcgag;

DRB1*0432:
(SEQ ID NO: 2570)
ttggagcaggttaaacatgagtgtcatttcttcaacgggacggagcgggtgcggttcctggacagatacttctatc accaagaggagtacgtgcgcttcgacagcgacgtgggggagtaccgggcggtgacggagctggggcggcctgatgc cgagtactggaacagccagaaggacctcctggagcagaggcAggccgcggtggacacctactgcagacacaactac ggggttgtggag;

DRB1*0433:
(SEQ ID NO: 2571)
cacgtttcttggagcaggttaaacatgagtgtcatttcttcaacgggacggagcgggtgcggttcctggacagata cttctatcaccaagaggagtacgtgcActtcgacagcgacgtgggggagtaccgggcggtgacggagctggggcgg cctgatgccgagtactggaacagccagaaggacctcctggagcagaagcgggccgcggtggacacctactgcagac acaactacggggttggtgagagcttcacagtgcagcggcgag;

DRB1*0434:
(SEQ ID NO: 2572)
tttcttggagcaggttaaaCCtgagtgtcatttcttcaacgggacggagcgggtgcggttcctggacagatacttc tatcaccaagaggagtAcgtgcgcttcgacagcgacgtgggggagtaccgggcggtgacggagctggggcggcctg atgccgagtactggaacagccagaaggacctcctggagcagaAgcgggccgcggtggacacctactgcagacacaa ctacggggttggtga;

DRB1*0435:
(SEQ ID NO: 2573)
cacgtttcttggagcaggttaaaCatgagtgtcatttcttcaacgggacggagcgggtgcggttcctggacagata cttctatcaccaagaggagtacgtgcgcttcgacagcgacgtgggggagtTccgggcggtgacggagctggggcgg cctgatgccgagtactggaacagccagaaggacctcctggagcagaAgcgggccgcggtggacacctactgcagac acaactacggggttggtgagagcttcacagtg;

DRB1*0436:
(SEQ ID NO: 2574)
cacgtttcttggagcaggttaaaCatgagtgtcatttcttcaacgggacggagcgggtgcggttcctggacagata cttctatcaccaagaggagtacgtgcgcttcgacagcgacgtgggggagtaccgggcggtgacggagctggggcgg cctgatgccgagtactggaacagccagaaggacTtcctggaagaCaggcgggccgcggtggacacctactgcagac acaactacggggttgtGgagagcttcacagtgcagcggcgag;

DRB1*0437:
(SEQ ID NO: 2575)
cacgtttcttggagcaggttaaaCatgagtgtcatttcttcaacgggacggagcgggtgcggttcctggacagata cttctatcaccaagaggagtacgtgcgcttcgacagcgacgtgggggagtaccgggcggtgacggagctggggcgg cctgatgccgagtactggaacagccagaaggacctcctggaagacGAgcgggccgcggtggacacctactgcagac acaactacggggttgtGgagagcttcacagtgcagcggcgag;

DRB1*0438:
(SEQ ID NO: 2576)
cacgtttcttggagcaggttaaaCatgagtgtcatttcttcaacgggacggagcgggtgcggttcctggacagata cttctatcaccaagaggagtacgtgcgcttcgacagcgacgtgggggagtaccgggcggtgacggagctggggcgg DRB1*0439:
(SEQ ID NO: 2577)
cacgtttcttggagcaggttaaacatgagtgtcatttcttcaacgggacggagcgggtgcggttcctggacagata cttctatcaccaagaggagtacgtgcgcttcgacagcgacgtgggggaCtaccgggcggtgacggagctggggcgg cctgatgccgagtactggaacagccagaaggacctcctggagcagaggcgggccgaggtggacacctactgcagac acaactacggggttgtggagagcttcacagtgcagcgg;

DRB1*0440:
(SEQ ID NO: 2578)
cacgtttcttggagcaggttaaacatgagtgtcatttcttcaacgggacggagcgggtgcggttcctggacagata cttctatcaccaagaggagtacgtgcgcttcgacagcgacgtgggggagtaccgggcggtgacggagctggggcgg cctgatgGcgagtactggaacagccagaaggacctcctggagcagaggcgggccgcggtggacacctactgcagac acaactacggggttgtggagagcttcacagtgcagcgg;

DRB1*0441:
(SEQ ID NO: 2579)
cacgtttcttggagcaggttaaaCatgagtgtcatttcttcaacgggacggagcgggtgcggttcctggacagata cttctatcaccaagaggagAAcgtgcgcttcgacagcgacgtgggggagtaccgggcggtgacggagctggggcgg cctgatgccgagtactggaacagccagaaggacctcctggagcagaggcgggccgAggtggacacctactgcagac acaactacggggttgtGgagagcttcacagtgcagcgg;

DRB1*0442:
(SEQ ID NO: 2580)
cacgtttcttggagcaggttaaaCatgagtgtcatttcttcaacgggacggagcgggtgcggttcctggacagata cttctatcaccaagaggagtacgtgcgcttcgacagcgacgtgggggagtTccgggcggtgacggagctggggcgg cctgatgccgagtactggaacagccagaaggacctcctggagcagaggcgggccgcggtggacacctactgcagac acaactacggggttgtGgagagcttcacagtgcagcggcgag;

DRB1*0443;
(SEQ ID NO: 2581)
cacgtttcttggagcaggttaaaCatgagtgtcatttcttcaacgggacggagcgggtgcggttcctggacagata cttctatCaccaagaggagtacgtgcgcttcgacagcgacgtggggagtTccgggcggtgacggagctggggcgg cctgatgccgagtactggaacagccagaaggacctcctggagcagaggcgggccgcggtggacacctactgcagac acaactacggggttggtgagagcttcacagtgcagcgg;

DRB1*0444:
(SEQ ID NO: 2582)
cacgtttcttggagcaggttaaacatgagtgtcatttcttcaacgggacggagcgggtgcggttcctggacagata cttctatCaccaagaggagtAcgtgcgcttcgacagcgacgtgggggagtaccgggcggtgacggagctggggcgg cctgatgccgagtactggaacagccagaaggacctcctggagcagaggcgggccgcggtggacaaTtactgcagac acaactacggggttgtGgagagcttcacagtgcagc;

DRB1*070101:
(SEQ ID NO: 2583)
atggtgtgtctgaagctccctggaggctcctgcatggcagctctgacagtgacactgatggtgctgagctccccac tggctttggctggggacacccAaccacgtttcctgtggcagggtaagtataagtgtcatttcttcaacgggacgga gcgggtgcagttcctggaaagactcttctataaccaggaggagttcgtgcgcttcgacagcgacgtgggggagtac cgggcggtgacggagctagggcggcctgtcgccgagtcctggaacagccagaaggacatcctggaggacaggcggg gcCaggtggacaccgtGtgcagacacaactacggggttggtgagagcttcacagtgcagcggcgag;

DRB1*070102:

(SEQ ID NO: 2584)
cacgtttcctgtggcagggtaaAtataagtgtcatttcttcaacgggacggagcgggtgcagttcctggaaagact cttctataaccaggaggagttcgtgcgcttcgacagcgacgtgggggagtaccgggcggtgacggagctAgggcgg cctgtcgccgagtCctggaacagccagaaggacatcctggaggacaggcggggccaggtggacaccgtGtgcagac acaactacggggttggtg;

DRB1*0703:

(SEQ ID NO: 2585)
cacgtttcctgtggcagggtaagtataagtgtcatttcttcaacgggacggagcgggtgcagttcctggaaagTct cttctataaccaggaggagttcgtgcgcttcgacagcgacgtgggggagtaccgggcggtgacggagctagggcgg cctgtcgccgagtcctggaacagccagaaggacatcctggaggacaggcggggccaggtggacaccgtgtgcagac acaactacggggttggtg;

DRB1*0704:

(SEQ ID NO: 2586)
tttcctgtggcagggtaagtataagtgtcatttcttcaacgggacggagcgggtgcagttcctggaaagactcttc tataaccaggaggagttcgtgcgcttcgacagcgacgtgggggagtaccgggcggtgacggagctAgggcggcctg tcgccgagtcctggaacagccagaaggacatcctggaggacaggcggggccaggtggacaaTtactgcagacacaa ctacggggttggtgagagc;

DRB1*0705:

(SEQ ID NO: 2587)
cacgtttcctgtggcagggtaagtataagtgtcatttcttcaacgggacggagcgggtgcagttcctggaaagact cttctataaccaggaggagttcgtgcgcttcgacagcgacgtgggggagtaccgggcggtgacggagctagggcgg cctgtcgccgagtcctggaacagcCgaaggacatcctggaggacaggcggggccaggtggacaccgtgtgcagac acaactacggggttggtgagagcttcacag;

DRB1*0706:

(SEQ ID NO: 2588)
cacgtttcctgtggcagggtaagtataagtgtcatttcttcaacgggacggagcgggtgcagttcctggaaagact cttctataaccaggaggagttcgtgcgcttcgacagcgacgtgggggagtaccgggcggtgacggagctAgggcgg cctgctgcGgagtactggaacagccagaaggacatcctggaggacaggcggggccaggtggacaccgtGtgcagac acaactacggggttggtgagagcttcacagtgcagcggcgag;

DRB1*0707:

(SEQ ID NO: 2589)
cacgtttcctgtggcagggtaagtataagtgtcatttcttcaacgggacggagcgggtgcagttcctggaaagact cttctataaccaggaggagttcgtgcgcttcgacagcgacgtgggggagtaccgggcggtgacggagctagggTgg cctgtcgccgagtcctggaacagccagaaggacatcctggaggacaggcggggccaggtggacaccgtgtgcagac acaactacggggttggtgagagcttcacagtg;

DRB1*080101:

(SEQ ID NO: 2590)
ggggacacccgaccacgtttcttggagtactctacgggtgagtgtTatttcttcaatgggacggagcgggtgcgt tcctggacagatacttctataaccaagaggagtacgtgcgcttcgacagcgacgtgggggagtaccgggcggtgac ggagctggggcggcctagCgccgagtactggaacagccagaaggacTtcctggaagacaggcgggcccTggtggac acctactgcagacacaactacggggttggtgagagcttcacGgtgcagcggcgag;

DRB1*080102:

(SEQ ID NO: 2591)
cacgtttcttggagtactctacgggtgagtgttatttcttcaatgggacggagcgggtgcggttcctggacagata Tttctataaccaagaggagtacgtgcgcttcgacagcgacgtgggggagtaccgggcggtgacggagctggggcgg cctagcgccgagtactggaacagccagaaggacttcctggaagacaggcgggccctggtggacacctactgcagac acaactacggggttggtgagagcttcacggtgcagcggcgag;

-continued

DRB1*080201:
(SEQ ID NO: 2592)
atggtgtgtctgaggctccctggaggctcctgcatggcagTtctgacagtgacactgatggtgctgagctccccac
tggctttggctggggacaccagaccacgtttcttggagtactctacggtgagtgttatttcttcaatgggacgga
gcgggtgcggttcctggacagatacttctataaccaagaggagtacgtgcgcttcgacagcgacgtgggggagtac
cgggcggtgacggagctggggcggcctgatgccgagtactggaacagccagaaggacttcctggaagacaggcggg
ccctggtggacacctactgcagacacaactacggggttggtgagagcttcacGgtgcagcggcgag;

DRB1*080202:
(SEQ ID NO: 2593)
cacgtttcttggagtactctacggtgagtgtTatttcttcaatgggacggagcgggtgcggttcctggacagata
cttctataaccaagaggagtAcgtgcgcttcgacagcgacgtgggggagtaccgggcggtgacggagctggggcgg
cctgatgccgagtactggaacagccagaaggacTtcctggaagacaggcgggcccTggtggacacctactgcagac
acaactacggggttggtgagagcttcacagtgcagcggcgag;

DRB1*080203:
(SEQ ID NO: 2594)
cgtttcttggagtactctacggtgagtgttatttcttcaatgggacggagcgggtgcggttcctggacagatact
tctataaccaagaggagtacgtgcgcttcgacagcgacgtgggggagtaccgggcggtgacAgagctggggcggcc
tgatgccgagtactggaacagccagaaggacttcctggaagacaggcgggccctggtggacacctactgcagacac
aactacggggttggtgagagcttcacggtg;

DRB1*080302:
(SEQ ID NO: 2595)
ggggacaccagaccacgtttcttggagtactctaCggtgagtgtTatttcttcaatgggacggagcgggtgcggt
tcctggacagatacttctataaccaagaggagtacgtgcgcttcgacagcgacgtgggggagtaccgggcggtgac
ggagctggggcggcctaGcgccgagtactggaacagccagaaggacAtcctggaagacaggcgggcccTggtggac
acctactgcagacacaactacggggttggtgagagcttcacagtgcagcggcgag;

DRB1*080401:
(SEQ ID NO: 2596)
ggggacaccagaccacgtttcttggagtactctacggtgagtgtTatttcttcaatgggacggagcgggtgcggt
tcctggacagatacttctataaccaagaggagtAcgtgcgcttcgacagcgacgtgggggagtaccgggcggtgac
ggagctggggcggcctgatgccgagtactggaacagccagaaggacTtcctggaagacaggcgggcccTggtggac
acctactgcagacacaactacggggttgtGgagagcttcacagtgcagcggcgag;

DRB1*080402:
(SEQ ID NO: 2597)
ttcaatgggacggagcgggtgcggttcctggacagatacttctataaccaagaggagtAcgtgcgcttcgacagcg
acgtgggggagtaccgggcggtgacggagctggggcggcctgatgccgagtactggaacagccagaaggacTtcct
ggaagacaggcgggcccTgtggacacctactgcagacacaactacggggttgTtgagagcttcacagtgcagcgg;

DRB1*080403:
(SEQ ID NO: 2598)
cacgtttcttggagtactctacggtgagtgttatttcttcaatgggacggagcgggtgcggttcctggacagata
cttctataaccaagaggagtacgtgcgcttcgacagcgacgtgggggagtaccgggcggtgacggagctggggcgg
cctgatgccgagtactggaacagccagaaggacttcctggaagacaggcgggcccTggtggacacctactgcagac
acaactacggggttgTtgagagcttcacGgtgcagcggcga;

DRB1*080404:
(SEQ ID NO: 2599)
cacgtttcttggagtactctacggtgagtgttatttcttcaatgggacggagcgggtgcggttcctggacagata
cttctataaccaagaggagtacgtgcgcttcgacagcgacgtgggggagtaccgggcggtgacggagctggggcgg
cctgatgccgagtactggaacagccagaaggacttcctggaagacaggcgggcccTggtggacacctactgcagac
acaactacggggttgtGgagagcttcacGgtgcagcggcgag;

DRB1*0805:
(SEQ ID NO: 2600)
cacgtttcttggagtactctacgggtgagtgtTatttcttcaatgggacggagcgggtgcggttcctggacagata cttctataaccaagaggagtacgtgcgcttcgacagcgacgtgggggagtaccgggcggtgacggagctggggcgg cctaGcgccgagtactggaacagccagaaggacTtcctggaagaCaggcgggccgcggtggacacctactgcagac acaactacggggttggt;

DRB1*0806:
(SEQ ID NO: 2601)
ccacgtttcttggagtactctacgggtgagtgttatttcttcaatgggacggagcgggtgcggttcctggacagat acttctataaccaagaggagtacgtgcgcttcgacagcgacgtgggggagtaccgggcggtgacggagctggggcg gcctaGcgccgagtactggaacagccagaaggacTtcctggaagacaggcgggcccTggtggacacctactgcaga cacaactacggggttgtGgagagcttcacagtgcagcggcgag;

DRB1*0807:
(SEQ ID NO: 2602)
cacgtttcttggagtactctacgggtgagtgttatttcttcaatgggacggagcgggtgcggttcctggacagata cttctataaccaagaggagtacgtgcgcttcgacagcgacgtgggggagtaccgggcggtgacggagctggggcgg cctgTtgccgagtactggaacagccagaaggacTtcctggaagacaggcgggcccTggtggacacctactgcagac acaactacggggttggtgagagcttcacGgtgcagcggcgag;

DRB1*0808:
(SEQ ID NO: 2603)
ttggagtactctacgggtgagtgttatttcttcaatgggacggagcgggtgcggttcctggacagatacttctata accaagaggagtacgtgcgcttcgacagcgacgtgggggagtaccgggcggtgacggagctggggcggcctgCtgc ggagCactggaacagccagaaggacttcctggaagacaggcgggcccTggtggacacctactgcagacacaactac ggggttggtgag;

DRB1*0809:
(SEQ ID NO: 2604)
cacgtttcttggagtactctaCgggtgagtgttatttcttcaatgggacggagcgggtgcggttcctggacagata cttccataaccaggaggagtTcgtgcgcttcgacagcgacgtgggggagtaccgggcggtgacggagctggggcgg cctgatgccgagtactggaacagccagaaggacTtcctggaagacaggcgggcccTggtggacacctactgcagac acaactacggggttggtgagagcttcacGgtgcagcggcgag;

DRB1*0810:
(SEQ ID NO: 2605)
cacgtttcttggagtactctacgggtgagtgtTatttcttcaatgggacggagcgggtgcggttcctggacagata cttctataaccaagaggagtacgtgcgcttcgacagcgacgtgggggagtaccgggcggtgacggagctggggcgg cctaGcgccgagtactggaacagccagaaggacAtcctggaagacaggcgggcccTggtggacacctactgcagac acaactacggggttgtGgagagcttcacagtgcagcggcgag;

DRB1*0811:
(SEQ ID NO: 2606)
cacgtttcttggagtactctacgggtgagtgttatttcttcaatgggacggagcgggtgcggttcctggacagata cttctataaccaagaggagtacgtgcgcttcgacagcgacgtgggggagtaccgggcggtgacggagctggggcgg cctgCtgccgagtactggaacagccagaaggacttcctggaagacaggcgggcccTggtggacacctactgcagac acaactacggggttggtgagagcttcacGgtg;

DRB1*0812:
(SEQ ID NO: 2607)
cacgtttcttggagtactctacgggtgagtgttatttcttcaatgggacggagcgggtgcggttcctggacagata cttctataaccaagaggagtacgtgcgcttcgacagcgacgtgggggagtaccgggcggtgacggagctggggcgg cctagcgccgagtactggaacagccagaaggacAtcctggaagacaggcgggcccTggtggacacctactgcagac acaactacggggCtgtggagagcttcacagtgcagcggcgag;

-continued

DRB1*0813:
(SEQ ID NO: 116 2608)
tcttggagtactctacgggtgagtgtTatttcttcaatgggacggagcgggtgcggttcctggacagatacttcta taaccaagaggagtAcgtgcgcttcgacagcgacgtgggggagtaccgggcggtgacggagctggggcggcctgat gccgagtactggaacagccagaaggacctcctggaagacaggcgggcccTggtggacacctactgcagacacaact acggggttggtgagagcttcacGgtg;

DRB1*0814:
(SEQ ID NO: 2609)
cacgtttcttggagtactctaGgggtgagtgttatttcttcaatgggacggagcgggtgcggttcctggacagata cttctataaccaagaggagtacgtgcgcttcgacagcgacgtgggggagtaccgggcggtgacggagctggggcgg cctagcgccgagtactggaacagccagaaggacatcctggaagacaggcgggccctggtggacacctactgcagac acaactacggggttggtgagagcttcacagtg;

DRB1*0815:
(SEQ ID NO: 2610)
tttcttggagtactctacgggtgagtgttatttcttcaatgggacggagcgggtgcggttcctggacagatacttc tataaccaagaggagtacgtgcgcttcgacagcgacgtgggggagtaccgggcggtgacggagctggggcggcctg atgcggagCactggaacagccagaaggacAtcctggaagacaggcgggcccTggtggacacctactgcagacacaa ctacggggttggtg;

DRB1*0816:
(SEQ ID NO: 2611)
cacgtttcttggagtactctacgggtgagtgttatttcttcaatgggacggagcgggtgcggttcctggacagata cttctataaccaagaggagGacgtgcgcttcgacagcgacgtgggggagtaccgggcggtgacggagctggggcgg cctagcgccgagtactggaacagccagaaggacttcctggaagacaggcgggccctggtggacacctactgcagac acaactacggggttggtgagagcttcacGgtgcagcggcgag;

DRB1*0817:
(SEQ ID NO: 2612)
cacgtttcttggagtactctacgggtgagtgttatttcttcaatgggacggagcgggtgcggttcctggacagata cttctataaccaagaggagtacgtgcgcttcgacagcgacgtgggggagtTccgggcggtgacggagctggggcgg cctaGcgccgagtactggaacagccagaaggacTtcctggaagacaggcgggcccTggtggacacctactgcagac acaactacggggttggtg;

DRB1*0818:
(SEQ ID NO: 2613)
cacgtttcttggagtactctaCgggtgagtgtTatttcttcaatgggacggagcgggtgcggttcctggacagata cttctataaccaagaggagtacgtgcgcttcgacagcgacgtgggggagtaccgggcggtgacggagctggggcgg cctaGcgccgagtactggaacagccagaaggacAtcctggaagaCaggcgggccgcggtggacacctactgcagac acaactacggggttggtgagagcttcacagtgcagcggcgag;

DRB1*0819:
(SEQ ID NO: 2614)
tttcttggagtactctacgggtgagtgttatttcttcaatgggacggagcgggtgcggttcctggacagatacttc tataaccaagaggagtacgtgcgcttcgacagcgacgtgggggagtaccgggcggtgacggagctggggcggccta TcgccgagtactggaacagccagaaggacAtcctggaagacaggcgggcccTggtggacacctactgcagacacaa ctacggggttggtgagagcttcacagtgc;

DRB1*0820:
(SEQ ID NO: 2615)
cacgtttcttggagtactctacgtCtgagtgtcatttcttcaatgggacggagcgggtgcggttcctggacagata cttctataaccaagaggagtAcgtgcgcttcgacagcgacgtgggggagtaccgggcggtgacggagctggggcgg cctgatgccgagtactggaacagccagaaggacTtcctggaagacaggcgggcccTggtggacacctactgcagac acaactacggggttgtGgagagcttcacagtgcagcggcga;

DRB1*0821:
(SEQ ID NO: 2616)
cacgtttcttggagtactctaTgggtgagtgttatttcttcaatgggacggagcgggtgcggttcctggacagata cttccataaccaggaggagttcgtgcgcttcgacagcgacgtgggggagtaccgggcggtgacggagctggggcgg cctgatgccgagtactggaacagccagaaggacttcctggaagacaggcgggccctggtggacacctactgcagac acaactacggggttggtgagagcttcacggtgcagcggcga;

DRB1*0822:
(SEQ ID NO: 2617)
cacgtttcttggagtactctacgggtgagtgttatttcttcaatgggacggagcgggtgcggttcctggacagata cttctataaccaagaggagtacgtgcgcttcgacagcgacgtgggggagtaccgggcggtgacggagctggggcgg cctagcgccgagtactggaacagccagaaggacttcctggaagacaggcgggccctggtggacacctactgcagac acaactacggggCtgtGgagagcttcacGgtgcagcggcgag;

DRB1*0823:
(SEQ ID NO: 2618)
cacgtttcttggagtactctacgggtgagtgttatttcttcaatgggacggagcgggtgcggttcctggacagata cttctataaccaagaggagtacgtgcgcttcgacagcgacgtgAgggagtaccgggcggtgacggagctggggcgg cctagcgccgagtactggaacagccagaaggacatcctggaagacaggcgggcccTggtggacacctactgcagac acaactacggggttggtgagagcttcacagtgcagcggcgag;

DRB1*0824:
(SEQ ID NO: 2619)
cacgtttcttggagtactctacgggtgagtgtTatttcttcaatgggacggagcgggtgcggttcctggacagata cttctataaccaagaggagtAcgtgcgcttcgacagcgacgtgggggagtaccgggcggtgacggagctggggcgg cctgatgccgagtactggaacagccagaaggacTtcctggaagaCaggcgggccgcggtggacacctactgcagac acaactacggggttggtgagagcttcacagtgcagcgg;

DRB1*090102:
(SEQ ID NO: 2620)
ggggacacccaaccacgtttcttgaagcaggataagtttgagtgtcatttcttcaacgggacggagcgggtgcggt atctgcacagaggcatctataaccaagaggagaacgtgcgcttcgacagcgacgtgggggagtaccgggcggtgac ggagctggggcggcctgtcgccgagtCctggaacagccagaaggacttcctggagcggaggcgggccgaggtggac accgtgtgcagacacaactacggggttggtgagagcttcacagtgcagAggcgag;

DRB1*0902:
(SEQ ID NO: 2621)
cacgtttcttgaagcaggataagtttgagtgtcatttcttcaacgggacggagcgggtgcggtatctgcacagagg catctataaccaagaggagaacgtgcgcttcgacagcgacgtgggggagtaccgggcggtgacggagctggggcgg cctgacgcTgagtactggaacagccagaaggacttcctggagcggaggcgggccgaggtggacaccgtgtgcagac acaactacggggttggtgagagcttcacagtgcagAggcgag;

DRB1*100101:
(SEQ ID NO: 2622)
atggtgtgtctgaggctccctggaggctcctgcatggcagttctgacagtgacactgatggtgctgagctccccac tggctttggctggggacaccagaccacgtttcttggaggaggttaagtttgagtgtcatttcttcaacgggacgga gcgggtgcggttgctggaaagacgcgtccataaccaagaggagtacgcgcgctacgacagcgacgtgggggagtac cgggcggtgacggagctggggcggcctgatgccgagtactggaacagccagaaggacctcctggagcggaggcgTg ccgcggtggacacctactgcagacacaactacggggttggtgagagcttcacagtgcagcggcgag;

DRB1*100102:
(SEQ ID NO: 2623)
cacgtttcttggaggaggttaagtttgagtgtcatttcttcaacgggacggagcgggtgcggttgctggaaagacg cGtccataaccaagaggagtacgcgcgctacgacagcgacgtgggggagtaccgggcggtgacggagctggggcgg cctgatgccgagtactggaacagccagaaggacctcctggagcggaggcgCgccgcggtggacacctactgcagac acaactacggggttggtgagagcttcacagtgcagcggcgag;

DRB1*110101:

(SEQ ID NO: 2624)

atggtgtgtctgaggctccctggaggctcctgcatggcagTtctgacagtgacactgatggtgctgagctccccac tggctttggctgggga caccagaccacgtttcttggagtactctacgtctgagtgtcatttcttcaatgggacgga gcgggtgcggttcctggacagatacttctataaccaagaggagtacgtgcgcttcgacagcgacgtgggggagttc cgggcggtgacggagctggggcggcctgatgaGgagtactggaacagccagaaggacTtcctggaagaCaggcggg ccgcggtggacacctactgcagacacaactacggggttggtgagagcttcacagtgcagcggcgag;

DRB1*110102:

(SEQ ID NO: 2625)

ggggacaccagaccacgtttcttggagtactctacgtctgagtgtcatttcttcaatgggacggagcgggtgcggt tcctggacagatacttctataaccaagaggagtacgtgcgcttcgacagcgacgtgggggagttccgggcggtgac ggagctggggcggcctgatgaGgagtactggaacagccagaaggacTtcctggaagaCaggcgggccgcggtggac acctactgcagacacaactacggggttggtgagagcttcacGgtgcagcggcgag;

DRB1*110103:

(SEQ ID NO: 2626)

cacgtttcttggagtactctacgtctgagtgtcatttcttcaatgggacggagcgggtgcggttcctggacagata cttctataaccaagaggagtacgtgcgcttcgacagcgacgtgggggagttccgggcggtgacggagctggggcgg cctgatgaGgagtactggaacagccagaaggacTtcctggaaGaCaggcgCgccgcggtggacacctactgcagac acaactacggggttggtgagagcttcacagtgcagcggcgag;

DRB1*110104:

(SEQ ID NO: 2627)

cgtttcttggagtactctacgtctgagtgtcatttcttcaaCggacggagcgggtgcggttcctggacagatact tctataaccaagaggagtAcgtgcgcttcgacagcgacgtgggggagtTccggcggtgacggagctggggcggcc tgatgAggagtactggaacagccagaaggacTtcctggaagaCaggcgggccgcggtggacacctactgcagacac aactacggggttggtgagagcttcacagtgcagcggcgag;

DRB1*1102:

(SEQ ID NO: 2628)

ggggacaccagaccacgtttcttggagtactctacgtctgagtgtcatttcttcaatgggacggagcgggtgcggt tcctggacagatacttctataaccaagaggagtacgtgcgcttcgacagcgacgtgggggagttccgggcggtgac ggagctggggcggcctgatgAggagtactggaacagccagaaggacAtcctggaagacGAgcgggccgcggtggac acctactgcagacacaactacggggttgtGgagagcttcacagtgcagcggcgag;

DRB1*1103:

(SEQ ID NO: 2629)

atggtgtgtctgaggctccctggaggctcctgcatggcagTtctgacagtgacactgatggtgctgagctccccac tggctttggctggggacaccagaccacgtttcttggagtactctacgtctgagtgtcatttcttcaatgggacgga gcgggtgcggttcctggacagatacttctataaccaagaggagtacgtgcgcttcgacagcgacgtgggggagttc cgggcggtgacggagctggggcggcctgatgaggagtactggaacagccagaaggacttcctggaagacgAgcggg ccgcggtggacacctactgcagacacaactacggggttgtGgagagcttcacagtgcagcggcgag;

DRB1*110401:

(SEQ ID NO: 2630)

atggtgtgtctgaggctccctggaggctcctgcatggcagTtctgacagtgacactgatggtgctgagctccccac tggctttggctggggacaccagaccacgtttcttggagtactctacgtctgagtgtcatttcttcaatgggacgga gcgggtgcggttcctggacagatacttctataaccaagaggagtacgtgcgcttcgacagcgacgtgggggagttc cgggcggtgacggagctggggcggcctgatgaggagtactggaacagccagaaggacTtcctggaagaCaggcggg ccgcggtggacacctactgcagacacaactacggggttgtGgagagcttcacagtgcagcggcgag;

DRB1*110402:
(SEQ ID NO: 2631)
ggggacaccagaccacgtttcttggagtactctacgtctgagtgtcatttcttcaatgggacggagcgggtgcggt tcctggacagatacttctataaccaagaggagtacgtgcgcttcgacagcgacgtgggggagttccgggcggtgac ggagctggggcggcctgatgaGgagtactggaacagccagaaggacttcctggaagacaggcgggccgcggtggac acctactgcagacacaactacggggttgtGgagagcttcacGgtgcagcggcgag;

DRB1*1105:
(SEQ ID NO: 2632)
ccacgtttcttggagtactctacgGgtgagtgtcatttcttcaatgggacggagcgggtgcggttcctggacagat acttctataaccaagaggagtacgtgcgcttcgacagcgacgtgggggagttccgggcggtgacggagctggggcg gcctgatgAGgagtactggaacagccagaaggacTtcctggaagaCaggcgggccgcggtggacacctactgcaga cacaactacggggttggtgagagcttcacagtgcagcggcga;

DRB1*110601:
(SEQ ID NO: 2633)
cgtttcttggagtactctacgtctgagtgtcatttcttcaatgggacggagcgggtgcggttcctggacagatact tctataaccaagaggagtacgtgcgcttcgacagcgacgtgggggagttccgggcggtgacggagctggggcggcc tgatgaGgagtactggaacagccagaaggacTtcctggaagaCaggcgggccgcggtggacacctactgcagacac aactacggggCtgtggagagcttcacagtgcagcggcgag;

DRB1*110602:
(SEQ ID NO: 2634)
tttcttggagtactctacgtctgagtgtcatttcttcaatgggacggagcgggtgcggttcctggacagatacttc tataaccaagaggagtacgtgcgcttcgacagcgacgtgggggagttccgggcggtgacggagctggggcggcctg atgaGgagtactggaacagccagaaggacTtcctggaagaCaggcgggccgcggtggacacctaTtgcagacacaa ctacggggCtgtggagagcttcacagtgcagcggcgag;

DRB1*1107:
(SEQ ID NO: 2635)
ttggagtactctacgtctgagtgtcatttcttcaatgggacggagcgggtgcggttcctggacagatacttctata accaagaggagtacgtgcgcttcgacagcgacgtgggggagttccgggcggtgacggagctggggcggcctgatgA GgagtactggaacagccagaaggacctcctggagcagaagcggggccGgtggacaActactgcagacacaactac ggggttgtGgagagcttcacagtgcagcggcgag;

DRB1*110801:
(SEQ ID NO: 2636)
gtctgagtgtcatttcttcaatgggacggagcgggtgcggttcctggacagatacttctataaccaagaggagtAc gtgcgcttcgacagcgacgtgggggagtTccgggcggtgacggagctggggcggcctgatgAggagtactggaaca gccagaaggacctcctggaagaCaggcgggccgcggtggacacctactgcagacacaactacggggttggtgagag cttcacagtg;

DRB1*110802:
(SEQ ID NO: 2637)
gtctgagtgtcatttcttcaatgggacggagcgggtgcggttcctggacagatacttctataaccaagaggagtac gtgcgcttcgacagcgacgtgggggagttccgggcggtgacggagctggggcggcctgatgaGgagtactggaaca gccagaaggacctcctggaagaCaggcgggccgcggtggacacctactgcagacacaactacggggttggtgagag cttcacGgtg;

DRB1*1109:
(SEQ ID NO: 2638)
catttcttcaatgggacggagcgggtgcggttcctggacagatacttccataaccaGgaggagAAcgtgcgcttcg acagcgacgtgggggagtTccgggcggtgacggagctggggcggcctgatgAggagtactggaacagccagaagga cTtcctggaagaCaggcgggccgcggtggacacctactgcagacacaactacggggttggtgagagcttcacagtg cag;

DRB1*1110:
(SEQ ID NO: 2639)
gagtgtcatttcttcaatgggacggagcgggtgcggttcctggacagatacttcCataaccaGgaggagtTcgtgc gcttcgacagcgacgtgggggagtTccgggcggtgacggagctggggcggcctgatgAggagtactggaacagcca gaaggacTtcctggaagaCaggcgggccgcggtggacacctactgcagacacaactacggggttggt;

DRB1*1111:
(SEQ ID NO: 2640)
tttcttggagtactctacgtctgagtgtcatttcttcaatgggacggagcgggtgcggttcctggacagatacttc tataaccaagaggagtacgtgcgcttcgacagcgacgtgggggagtTccgggcggtgacggagctggggcggcctg atgAggagtactggaacagccagaaggacTtcctggaagacGAgcgggccgcggtggacacctactgcagacacaa ctacggggttggtgagagcttcacagtgcagcggcgag;

DRB1*111201:
(SEQ ID NO: 2641)
gagtgtcatttcttcaatgggacggagcgggtgcggttcctggacagatacttctataaccaagaggagtTcgtgc gcttcgacagcgacgtgggggagtTccgggcggtgacggagctggggcggcctgatgAggagtactggaacagcca gaaggacTtcctggaagaCaggcgggccgcggtggacacctactgcagacacaactacggggttggt;

DRB1*111202:
(SEQ ID NO: 2642)
cacgtttcttggagtactctacgtCtgagtgtcatttcttcaatgggacggagcgggtgcggttcctggacagata cttctataaccaGgaggagtTcgtgcgcttcgacagcgacgtgggggagtTccgggcggtgacggagctggggcgg cctgatgAggagtactggaacagccagaaggacTtcctggaagaCaggcgggccgcggtggacacctactgcagac acaactacggggttggtgagagcttcacagtgcagcggcgag;

DRB1*1113:
(SEQ ID NO: 2643)
ggggacaccagaccacgtttcttggagtactctacgtctgagtgtcatttcttcaatgggacggagcgggtgcggt tcctggacagatacttccataaccaggaggagttcgtgcgcttcgacagcgacgtgggggagtTccgggcggtgac ggagctggggcggcctgatgAGgagtactggaacagccagaaggacctcctggagcGgaggcgggccgcggtggac acctaTtgcagacacaactacggggttgtGgagagcttcacagtgcagcggcga;

DRB1*1114:
(SEQ ID NO: 2644)
ggggacaccagaccacgtttcttggagtactctacgtctgagtgtcatttcttcaatgggacggagcgggtgcggt tcctggacagatacttctataaccaagaggagtacgtgcgcttcgacagcgacgtgggggagttccgggcggtgac ggagctggggcggcctgatgAggagtactggaacagccagaaggacAtcctggaagacGAgcgggccgcggtggac acctactgcagacacaactacggggttggtgagagcttcacagtgcagcggcgag;

DRB1*1115:
(SEQ ID NO: 2645)
ggggacaccagaccacgtttcttggagtactctacgtctgagtgtcatttcttcaatgggacggagcgggtgcggt tcctggacagatacttctataaccaagaggaggacTtgcgcttcgacagcgacgtgggggagttccgggcggtgac ggagctggggcggcctgatgaGgagtactggaacagccagaaggacTtcctggaaGaCaggcgggccgcggtggac acctactgcagacacaactacggggttggtgagagcttcacagtgcagcggcgag;

DRB1*1116:
(SEQ ID NO: 2646)
cacgtttcttggagtactctacgtctgagtgtcatttcttcaatgggacggagcgggtgcggttcctggacagata cttccataaccaggaggagAacgtgcgcttcgacagcgacgtgggggagttccgggcggtgacggagctggggcgg cctgatgAggagtactggaacagccagaaggacAtcctggaagacGAgcgggccgcggtggacacctactgcagac acaactacggggttgtGgagagcttcacagtgcagcggcgag;

DRB1*1117:
(SEQ ID NO: 2647)
ggggacaccagaccacgtttcttggagtactctacgtCtgagtgtcatttcttcaatgggacggagcgggtgcggt tcctggacagatacttccataaccaggaggagttcgtgcgcttcgacagcgacgtgggggagtaccgggcggtgac ggagctggggcggcctgatgAGgagtactggaacagccagaaggacctcctggagcggaggcgggccgAggtggac acctaTtgcagacacaactacggggttgtGgagagcttcacagtgcagcggcgag;

DRB1*1118:
(SEQ ID NO: 2648)
tttcttggagtactctacgtctgagtgtcatttcttcaatgggacggagcgggtgcggttcctggacagatacttc tataaccaagaggagtAcgtgcgcttcgacagcgacgtgggggagttccgggcggtgacggagctggggcggcctg atgAggagtactggaacagccagaaggacAtcctggaagaCaggcgggccgcggtggacacctactgcagacacaa ctacggggttgtGgagagcttcacagtgcagcggcgag;

DRB1*1119:
(SEQ ID NO: 2649)
tttcttggagtactctacgtctgagtgtcatttcttcaatgggacggagcgggtgcggttcctggacagatacttc tataaccaagaggagtAcgtgcgcttcgacagcgacgtgggggagttccgggcggtgacggagctggggcggcctg atgAggagtactggaacagccagaaggacAtcctggaagaCaggcgggccgcggtggacacctactgcagacacaa ctacggggttggtgagagcttcacagtgcagcggcgag;

DRB1*1120:
(SEQ ID NO: 2650)
ttggagtactctacgtctgagtgtcatttcttcaatgggacggagcgggtgcggttcctggacagatacttccata accaggaggagAacgtgcgcttcgacagcgacgtgggggagttccgggcggtgacggagctggggcggcctgatgA ggagtactggaacagccagaaggacAtcctggaagacGAgcgggccgcggtggacacctactgcagacacaactac ggggttggtgagagcttcacagtgcagc;

DRB1*1121:
(SEQ ID NO: 2651)
ttggagtactctacgtctgagtgtcatttcttcaatgggacggagcgggtgcggttcctggacagatacttctata accaagaggagtacgtgcgcttcgacagcgacgtgggggagttccgggcggtgacggagctggggcggcctgatga ggagtactggaacagccagaaggacatcctggaagacGAgcgggccgcggtggacacctactgcagacacaactac ggggCtgtggaga;

DRB1*1122:
(SEQ ID NO: 2652)
cacgtttcttggagcaggttaaaCatgagtgtcatttcttcaatgggacggagcgggtgcggttcctggacagata cttctataaccaggaggagtacgtgcgcttcgacagcgacgtgggggagtTccgggcggtgacggagctggggcgg cctgatgaGgagtactggaacagccagaaggacTtcctggaagaCaggcgggccgcggtggacacctactgcagac acaactacggggttggtgagag;

DRB1*1123:
(SEQ ID NO: 2653)
ccacgtttcttggagtactctacgtctgagtgtcatttcttcaatgggacggagcgggtgcggttcctggacagat acttctataaccaagaggagtacgtgcgcttcgacagcgacgtgggggagttccgggcggtgacggagctggggcg gcctgatgAGgagtactggaacagccagaaggacTtcctggaagaCaggcgggccCTggtggacacctactgcaga cacaactacggggttggtg;

DRB1*1124:
(SEQ ID NO: 2654)
ttcttggagtactctacgtctgagtgtcatttcttcaatgggacggagcgggtgcggttcctggacagatacttct ataaccaagaggagGacgtgcgcttcgacagcgacgtgggggagttccgggcggtgacggagctggggcggcctga tgaGgagtactggaacagccagaaggacTtcctggaaGaCaggcgggccgcggtggacacctactgcagacacaac tacggggttggtgagagcttcac;

DRB1*1125:
(SEQ ID NO: 2655)
cacgtttcttggagtactctacgtctgagtgtcatttcttcaatgggacggagcgggtgcggttcctggacagata cttctataaccaagaggagtacgtgcgcttcgacagcgacgtggggagttccgggcggtgacggagctggggcgg cctgatgaGgagtactggaacagccagaaggacTtcctggaagacaggcgggcccTggtggacacctactgcagac acaactacggggttgtGgagagcttcacagtgcagcggcgag;

DRB1*1126:
(SEQ ID NO: 2656)
ttggagtactctacgtCtgaGtgtcatttcttcaatgggacggagcgggtgcggttcctggacagatacttctata accaagaggagtAcgtgcgcttcgacagcgacgtggggagtTccgggcggtgacggagctggggcggcctgatgA ggagtactggaacagccagaaggacctcctggagcagaggcgggccgcggtggacacctactgcagacacaactac ggggttggtgag;

DRB1*112701:
(SEQ ID NO: 2657)
tttcttggagtactctacgtctgagtgtcatttcttcaatgggacggagcgggtgcggttcctggacagatacttc tataaccaagaggagtacgtgcgcttcgacagcgacgtgggggagttccgggcggtgacggagctggggcggcctg atgaggagtactggaacagccagaaggacttcctggaAgaCaggcgggccgcggtggacaaTtactgcagacacaa ctacggggttggtgagag;

DRB1*112702:
(SEQ ID NO: 2658)
cacgtttcttggagtactctacgtctgagtgtcatttcttcaatgggacggagcgggtgcggttcctggacagata cttctataaccaagaggagtacgtgcgcttcgacagcgacgtggggagttccgggcggtgacggagctggggcgg cctgatgAggagtactggaacagccagaaggacttcctggaagaCaggcgggccgcggtggacaActactgcagac acaactacggggttggtgagagcttcacagtgcagcggcgag;

DRB1*1128:
(SEQ ID NO: 2659)
cacgtttcttggagtactctacgtctgaGtgtcatttcttcaatgggacggagcgggtgcggttcctggacagata cttctataaccaagaggagAAcgtgcgcttcgacagcgacgtggggagtTccgggcggtgacggagctggggcgg cctgatgAggagtactggaacagccagaaggacTtcctggaagaCaggcgggccgcggtggacacctactgcagac acaactacggggttggtgagagcttcacagtgcagcggcgag;

DRB1*1129:
(SEQ ID NO: 2660)
cacgtttcttggagtactctaCgtCtgaGtgtcatttcttcaatgggacggagcgggtgcggttcctggacagata cttctataaccaagaggagtccgtgcgcttcgacagcgacgtggggagtTccgggcggtgacggagctggggcgg cctgatgAggagtactggaacagccagaaggacTtcctggaagaCaggcgggccgcggtggacacctactgcagac acaactacggggttggtgagagcttcacagtgcagcggcgag;

DRB1*1130:
(SEQ ID NO: 2661)
cacgtttcttggagcTgcttaagtctgagtgtcatttcttcaatgggacggagcgggtgcggttcctggacagata cttctataaccaagaggagtacgtgcgcttcgacagcgacgtggggagttccgggcggtgacggagctggggcgg cctgatgaggagtactggaacagccagaaggacttcctggaagaCaggcgggccgcggtggacacctactgcagac acaactacggggttggtgagagcttcacagtgcagcggcga;

DRB1*1131:
(SEQ ID NO: 2662)
ggggacaccagaccacgtttcttggagtactctacgtctgagtgtcatttcttcaatgggacggagcgggtgcggt tcctggacagatacttctataaccaagaggagtacgtgcgcttcgacagcgacgtggggagttccgggcggtgac ggagctggggcggcctgatgAggagCactggaacagccagaaggacAtcctggaagaCaggcgggccgcggtggac acctactgcagacacaactacggggttggtgagagcttcacagtgcagcggcgag;

DRB1*1132:
(SEQ ID NO: 2663)
cacgtttcttggagtactctacgtctgagtgtcatttcttcaatgggacggagcgggtgcggttcctggacagata cttctataaccaagaggagtacgtgcgcttcgacagcgacgtgggggagttccgggcggtgacggagctggggcgg cctgatgAGgagtactggaacagccagaaggacTtcctggaagaCaggcgggccgTggtggacacctactgcagac acaactacgggttggtgagagcttcacagtgcagcggcgag;

DRB1*1133:
(SEQ ID NO: 2664)
ttggagtactctacgtctgagtgtcatttcttcaatgggacggagcgggtgcggttcctggacagatacttctata accaagaggagtacgtgcgcttcgacagcgacgtgggggagttccgggcggtgacggagctggggcggcctgatga ggaCtactggaacagccagaaggacttcctggaagacaggcgggccgcggtggacacctactgcagacacaactac ggggttggtgagagcttcacagtgcagcggc;

DRB1*1134:
(SEQ ID NO: 2665)
cacgtttcttggagtactctacgtctgagtgtcatttcttcaatgggacggagcgggtgcggttcctggacagata cttctataaccaagaggagtAcgtgcgcttcgacagcgacgtgggggagtTccgggcggtgacggagctggggcgg cctgatgAggagtactggaacagccagaaggacctcctggagcagaggcgggccgcggtggacacctactgcagac acaactacggggttgtGgagagcttcacagtgcagcggcga;

DRB1*1135:
(SEQ ID NO: 2666)
ttggagtactctacgtctgagtgtcatttcttcaatgggacggagcgggtgcggttcctggacagatacttctata accaagaggagtacgtgcgcttcgacagcgacgtgggggagttccgggcggtgacggagctggggcggcctgatga ggaCtactggaacagccagaaggacttcctggaagacaggcgggccgcggtggacacctactgcagacacaactac ggggttgtGgagagcttcacagtgcagcggc;

DRB1*1136:
(SEQ ID NO: 2667)
cgtttcttggagtactctacgtctgagtgtcatttcttcaatggacggagcgggtgcggttcctggacagatact tctataaccaagaggagtacgtgcgcttcgacagcgacgtgggggagtTccgggcggtgacggagctggggcggcc tgatgAggagtactggaacagccagaaggacctcctggaagacGAgcgggccgcggtggacacctactgcagacac aactacggggttgtGgagagcttcacagtgcagcggcga;

DRB1*1137:
(SEQ ID NO: 2668)
cacgtttcttggagtactctaCgtCtgaGtgtcatttcttcaatgggacggagcgggtgcggttcctggacagata cttctataaccaagaggagtAcgtgcgcttcgacagcgacgtgggggagtaccgggcggtgacggagctggggcgg cctgatgAggagtactggaacagccagaaggacTtcctggaagaCaggcgggccgcggtggacacctactgcagac acaactacgggttggtgagagcttcacagtgcagcggcgag;

DRB1*1138:
(SEQ ID NO: 2669)
cacgtttcttggagtactctacgtctgagtgtcatttcttcaatgggacggagcgggtgcggttcctggacagata cttctataaccaagaggagtacgtgcgcttcgacagcgacgtgggggagttccgggcggtgacggagctggggcgg cctgatgaggGgtactggaacagccagaaggacttcctggaagacaggcgggccgcggtggacacctactgcagac acaactacggggttgtggagagcttcacagtgcagcggcgag;

DRB1*1139:
(SEQ ID NO: 2670)
cacgtttcttggagtactctacgtctgagtgtcatttcttcaatgggacggagcgggtgcggttcctggacagata cttctataaccaagaggagtacgtgcgcttcgacagcgacgtgggggagttccgggcggtgaGggagctggggcgg cctgatgaggagtactggaacagccagaaggacttcctggaagaCaggcgggccgcggtggacacctactgcagac acaactacgggttggtgagagcttcacagtgcagcggcgag;

DRB1*1140:
(SEQ ID NO: 2671)
cacgtttcttggagtactctacgtctgagtgtcatttcttcaatgggacggagcgggtgcggttcctggacagata cttccataaccaggaggagAacgtgcgcttcgacagcgacgtggggagtTccgggcggtgacggagctggggcgg cctgatgAggagtactggaacagccagaaggacTtcctggaagacGAgcgggccgcggtggacacctactgcagac acaactacggggttgtGg;

DRB1*1141:
(SEQ ID NO: 2672)
tttcttggagtactctacgtctgagtgtcatttcttcaatgggacggagcgggtgcggttcctggacagatacttc tataaccaagaggagtacgtgcgcttcgacagcgacgtggggagtaccgggcggtgacggagctggggcggcctg atgAggagtactggaacagccagaaggacTtcctggaagacGAgcgggccgcggtggacacctactgcagacacaa ctacggggttgtGgagagcttcacagtgcagcggcgag;

DRB1*1142:
(SEQ ID NO: 2673)
cacgtttcttggagtactctacgtctgagtgtcatttcttcaatgggacggagcgggtgcggttcctggacagata cttctataaccaagaggagtAcgtgcgcttcgacagcgacgtggggagtTccgggcggtgacggagctggggcgg cctgatgAggagtactggaacagccagaaggacctcctggaagaCaggcgggccgcggtggacacctactgcagac acaactacggggttgtGgagagcttcacagtgcagcggcgag;

DRB1*1143:
(SEQ ID NO: 2674)
cacgtttcttggagtactctacgtctgagtgtcatttcttcaatgggacggagcgggtgcggttcctggacagata cttctataaccaagaggagtacgtgcgcttcgacagcgacgtggggagttccgggcggtgaGggagctggggcgg cctgatgaggagtactggaacagccagaaggacttcctggaagaCaggcgggccgcggtggacacctactgcagac acaactacggggttgtGgagagcttcacagtgcagcggcgag;

DRB1*120101:
(SEQ ID NO: 2675)
atggtgtgtctgaggctccctggaggctcctgcatggcagtTctgacagtgacactgatggtgctgagctccccac tggctttggctggggacaccAgaccacgtttcttggagtactctacgggtgagtgttatttcttcaatgggacgga gcgggtgcggttActggagagacacttccataaccaggaggagCtcctgcgcttcgacagcgacgtgggggagttc cgggcggtgacggagctggggcggcctgtcgccgagtCctggaacagccagaaggacAtcctggaagacaggcgcg ccgcggtggacacctaTtgcagacacaactacggggCtgtggagagcttcacagtgcagcggcgag;

DRB1*120102:
(SEQ ID NO: 2676)
atggtgtgtctgaggctccctggaggctcctgcatggcagtTctgacagtgacactgatggtgctgagctccccac tggctttggctggggacaccAgaccacgtttcttggagtactctacgggtgagtgttatttcttcaatgggacgga gcgggtgcggttActggagagacacttccataaccaggaggagCtcctgcgcttcgacagcgacgtggggagttc cgggcggtgacggagctggggcggcctgtcgccgagtCctggaacagccagaaggacAtcctggaagacaggcggg ccgcggtggacacctactgcagacacaactacggggCtgtggagagcttcacagtgcagcggcgag;

DRB1*120201:
(SEQ ID NO: 2677)
cacgtttcttggagtactctacgggtgagtgttatttcttcaatgggacggagcgggtgcggttactggagagaca cttccataaccaggaggagCtcctgcgcttcgacagcgacgtggggagttccgggcggtgacggagctggggcgg cctgtcgccgagtcctggaacagccagaaggacTtcctggaagacaggcgcgccgcggtggacacctaTtgcagac acaactacggggCtgtggagagcttcacagtgcagcggcgag;

DRB1*120202:
(SEQ ID NO: 2678)
ttcttggagtactctacgggtgagtgttatttcttcaatgggacggagcgggtgcggttactggagagacacttcc ataaccaggaggagCtcctgcgcttcgacagcgacgtggggagttccgggcggtgacggagctggggcggcctgt cgccgagtcctggaacagccagaaggacTtcctggaagacaggcGccgcggtggacacctactgcagacacaac
tacggggCtgtggag;

DRB1*120302:
(SEQ ID NO: 2679)
cacgtttcttggagtactctacgggtgagtgttatttcttcaatgggacggagcgggtgcggttActggagagaca
cttccataaccaggaggagCtcctgcgcttcgacagcgacgtgggggagttccgggcggtgacggagctggggcgg
cctgtcgccgagtCctggaacagccagaaggacAtcctggaagacaggcGccgcggtggacacctactgcagac
acaactacggggttgtggagagcttcacagtgcagcgg;

DRB1*1204:
(SEQ ID NO: 2680)
gagtactctacgggtgagtgttatttcttcaatgggacggagcgggtgcggttactggagagacacttccataacc
aggaggagCtcctgcgcttcgacagcgacgtgggggagttccgggcggtgacggagctggggcggcctgatgaGga
gtactggaacagccagaaggacAtcctggaagacaggcgccgcggtggacacctaTtgcagacacaactacggg
gCtgtgg;

DRB1*1205:
(SEQ ID NO: 2681)
cacgtttcttggagtactctacgggtgagtgttatttcttcaatgggacggagcgggtgcggttActggagagaca
cttccataaccaggaggagttcctgcgcttcgacagcgacgtgggggagttccgggcggtgacggagctggggcgg
cctgtcgccgagtCctggaacagccagaaggacAtcctggaagacaggcgccgccgcggtggacacctaTtgcagac
acaactacggggCtgtggagagcttcacagtgcagcggcgag;

DRB1*1206:
(SEQ ID NO: 2682)
ggggacaccagaccacgtttcttggagtactctacgggtgagtgttatttcttcaatgggacggagcgggtgcggt
tActggagagacacttccataaccaggaggagCtcctgcgcttcgacagcgacgtgggggagttccgggcggtgac
ggagctggggcggcctgtcgccgagtCctggaacagccagaaggacAtcctggaagacaggcgcgccgcggtggac
acctaTtgcagacacaactacggggCtgtggagagcttcacagtgcagcggcgag;

DRB1*1207:
(SEQ ID NO: 2683)
cacgtttcttggagtactctacgggtgagtgttatttcttcaatgggacggagcgggtgcggttactggagagaca
cttccataaccaggaggagctcctgcgcttcgacagcgacgtgggggagttccgggcggtgacggagctggggcgg
cctgtcgccgagtcctggaacagccagaaggacatcctggGagacaggcgcgccgcggtggacacctattgcagac
acaactacggggctgtggagagcttcacagtgcagcggcgag;

DRB1*1208:
(SEQ ID NO: 2684)
cacgtttcttggagtactctacgggtgagtgttatttcttcaatgggacggagcgggtgcggttCctggagagaca
cttccataaccaggaggagCtcctgcgcttcgacagcgacgtgggggagttccgggcggtgacggagctggggcgg
cctgtcgccgagtCctggaacagccagaaggacAtcctggaagacaggcgcgccgcggtggacacctaTtgcagac
acaactacggggCtgtggagagcttcacagtgcagcggcgag;

DRB1*130101:
(SEQ ID NO: 2685)
ggggacaccagaccacgtttcttggagtactctacgtctgagtgtcatttcttcaatgggacggagcgggtgcggt
tcctggaCagatacttccataaccaggaggagAAcgtgcgcttcgacagcgacgtgggggagtTccgggcggtgac
ggagctggggcggcctgatgccgagtactggaacagccagaaggacAtcctggaagacGAgcgggccgcggtggac
acctactgcagacacaactacggggttgtGgagagcttcacagtgcagcggcgag;

DRB1*130102:
(SEQ ID NO: 2686)
cacgtttcttggagtactctacgtctgagtgtcatttcttcaatgggacggagcgggtgcggttcctggacagata
cttccataaccaggaggagaacgtgcgcttcgacagcgacgtgggggagttccgggcggtgacggagctggggcgg cctgatgccgagtactggaacagccagaaggacatcctggaagacgagcgggcTgcggtggacacctactgcagac acaactacggggttgtggagagcttcacagtgcagcggcgag;

DRB1*130103:
(SEQ ID NO: 2687)
cacgtttcttggagtactctacgtctgagtgtcatttcttcaatgggacggagcgggtgcggttcctggacagata cttccataaccaggaggagaacgtgcgcttcgacagcgacgtgggggagttccgggcggtgacggagctggggcgg cctgatgccgagtactggaacagccagaaggacatcctggaagacgAgcgggccgcggtggacacctaTtgcagac acaactacggggttgtGgagagcttcacagtgcagcggcgag;

DRB1*130201:
(SEQ ID NO: 2688)
ggggacaccagaccacgtttcttggagtactctacgtctgagtgtcatttcttcaatgggacggagcgggtgcggt tcctggaCagatacttccataaccaggaggagAAcgtgcgcttcgacagcgacgtgggggagtTccgggcggtgac ggagctggggcggcctgatgccgagtactggaacagccagaaggacAtcctggaagacGAgcgggccgcggtggac acctactgcagacacaactacggggttggtgagagcttcacagtgcagcggcgag;

DRB1*130202:
(SEQ ID NO: 2689)
cacgtttcttggagtactctacgtctgagtgtcatttcttcaatgggacggagcgggtgcggttcctggacagata cttccataaccaggaggagaacgtgcgcttcgacagcgacgtgggggagttccgggcggtgacggagctggggcgg cctgatgccgagtactggaacagccagaaggacatcctggaagacgAgcgCgccgcggtggacacctactgcagac acaactacggggttggtgagagcttcacagtgcagcgg;

DRB1*130301:
(SEQ ID NO: 2690)
ggggacaccagaccacgtttcttggagtactctacgtctgagtgtcatttcttcaatgggacggagcgggtgcggt tcctggacagatacttctataaccaagaggagtacgtgcgcttcgacagcgacgtgggggagtaccgggcggtgac ggagctggggcggcctagCgccgagtactggaacagccagaaggacatcctggaagaCaAgcgggccgcggtggac acctactgcagacacaactacggggttggtgagagcttcacGgtgcagcggcgag;

DRB1*130302:
(SEQ ID NO: 2691)
ttggagtactctacgtctgagtgtcatttcttcaatgggacggagcgggtgcggttcctggacagatacttctata accaagaggagtacgtgcgcttcgacagcgacgtgggggagtaccgggcggtgacggagctggggcggcctaGcgc cgagtactggaacagccagaaggacatcctggaagaCaAgcgggccgcggtggacacctactgcagacacaactac ggggttggtgagagcttcacagtgcagcggcgag;

DRB1*1304:
(SEQ ID NO: 2692)
ggggacaccagaccacgtttcttggagtactctacgtctgagtgtcatttcttcaatgggacggagcgggtgcggt tcctggacagatacttctataaccaagaggagtacgtgcgcttcgacagcgacgtgggggagtTccgggcggtgac ggagctggggcggcctaGcgccgagtactggaacagccagaaggacatcctggaagacGAgcgggccgcggtggac acctactgcagacacaactacggggttgtGgagagcttcacagtgcagcggcgag;

DRB1*1305:
(SEQ ID NO: 2693)
cgtttcttggagtactctacgtctgaGtgtcatttcttcaatgggacggagcgggtgcggttcctggacagatact tccataaccaGgaggagAacgtgcgcttcgacagcgacgtgggggagtTccgggcggtgacggagctggggcggcc tgatgccgagtactggaacagccagaaggacTtcctggaagaCaggcggggccgcggtggacacctactgcagacac aactacggggttggtgagagcttcacagtgcagcggcgag;

DRB1*1306:
(SEQ ID NO: 2694)
tgtcatttcttcaatgggacggagcgggtgcggttcctggaCagatacttccataaccaggaggagAacgtgcgct tcgacagcgacgtgggggagtTccgggcggtgacggagctggggcggcctgatgccgagtactggaacagccagaa ggacAtcctggaagaCaggcgggccgcggtggacacctactgcagacacaactacggggttgtGgagagcttcaca;

DRB1*130701:
(SEQ ID NO: 2695)
cacgtttcttggagtactCtaCgtCtgaGtgtcatttcttcaatgggacggagcgggtgcggttcctggaCagata
cTtctataaccaagaggagtAcgtgcgcttcgacagcgacgtgggggagtaccgggcggtgacggagctggggcgg
cctgatgccgagtactggaacagccagaaggacTtcctggaaGaCaggcgggccgcggtggacacctactgcagac
acaactacggggttggtgagagcttcacagtgcagcggcgag;

DRB1*130702:
(SEQ ID NO: 2696)
cacgtttcttggagtactctacgtCtgagtgtcatttcttcaatgggacggagcgggtgcggttcctggaCagata
cTtctataaccaagaggagtAcgtgcgcttcgacagcgacgtgggggagtaccgggcggtgacggagctggggcgg
cctgacgcTgagtactggaacagccagaaggacTtcctggaaGaCaggcgggccgcggtggacacctactgcagac
acaactacggggttggtgagagcttcacagtgcagcggcg;

DRB1*1308:
(SEQ ID NO: 2697)
ttcttggagtactctacgtctgagtgtcatttcttcaatgggacggagcgggtgcggttcctggaCagatacttcc
ataaccaggaggagtTcgtgcgcttcgacagcgacgtgggggagtaccgggcggtgacggagctggggcggcctga
tgccgagtactggaacagccagaaggacatcctggaagacGAgcgggccgcggtggacacctactgcagacacaac
tacggggttgtGgagagcttcacagtg;

DRB1*1309:
(SEQ ID NO: 2698)
tttcttggagtactctacgtctgagtgtcatttcttcaatgggacggagcgggtgcggttcctggacagatacttc
cataaccaggaggagaAcgtgcgcttcgacagcgacgtgggggagtTccgggcggtgacggagctggggcggcctg
atgccgagtactggaacagccagaaggacAtcctggagcaggCgcgggccgcggtggacacctactgcagacacaa
ctacggggttgtGgagagcttcacagtg;

DRB1*1310:
(SEQ ID NO: 2699)
cacgtttcttggagtactctacgtctgagtgtcatttcttcaatgggacggagcgggtgcggttcctggaCagata
cttccataaccaggaggagAacgtgcgcttcgacagcgacgtgggggagtTccgggcggtgacggagctggggcgg
cctgatgccgagtactggaacagccagaaggacAtcctggaagaCaGcgggccgcggtggacacctactgcagac
acaactacggggttgtGgagagcttcacagtgcagcggcgag;

DRB1*1311:
(SEQ ID NO: 2700)
cacgtttcttggagtactctacgtctgagtgtcatttcttcaatgggacggagcgggtgcggttcctggacagata
cttctataaccaagaggagtAcgtgcgcttcgacagcgacgtgggggagtTccgggcggtgacggagctggggcgg
cctgatgccgagtactggaacagccagaaggacTtcctggaagaCaggcgggccgcggtggacacctactgcagac
acaactacggggttgtGgagagcttcacagtgcagcggcgag;

DRB1*1312:
(SEQ ID NO: 2701)
cacgtttcttggagtactctacgtCtgagtgtcatttcttcaatgggacggagcgggtgcggttcctggacagata
cttctataaccaagaggagtacgtgcgcttcgacagcgacgtgggggagtaccgggcggtgacggagctggggcgg
cctaGcgccgagtactggaacagccagaaggacAtcctggaagaCaggcgggccgcggtggacacctactgcagac
acaactacggggttggtgagagcttcacagtgcagcggcgag;

DRB1*1313:
(SEQ ID NO: 2702)
cacgtttcttggagtactctacgtCtgagtgtcatttcttcaatgggacggagcgggtgcggttcctggacagata
cttctataaccaagaggagtacgtgcgcttcgacagcgacgtgggggagtaccgggcggtgacggagctggggcgg -continued cctaGcgccgagtactggaacagccagaaggacAtcctggaagacaggcgggcccTggtggacacctactgcagac acaactacggggttggtgagagcttcacagtgca;

DRB1*131401:
(SEQ ID NO: 2703)

tacgtctgagtgtcatttcttcaatgggacggagcgggtgcggttcctggacagatacttctataaccaagaggag tAcgtgcgcttcgacagcgacgtgggggagtTccgggcggtgacggagctggggcggcctgatgccgagtactgga acagccagaaggacTtcctggaaGaCaggcgggccgcggtggacacctactgcagacacaactacggggttggtg;

DRB1*131402:
(SEQ ID NO: 2704)

cacgtttcttggagtactctacgtctgagtgtcatttcttcaatgggacggagcgggtgcggttcctggacagata cttctataaccaagaggagtacgtgcgcttcgacagcgacgtgggggagtTccgggcggtgacggagctggggcgg cctgacgcTgagtactggaacagccagaaggacTtcctggaaGaCaggcgggccgcggtggacacctactgcagac acaactacggggttggtgagagcttcacagtgcagcggcgag;

DRB1*1315:
(SEQ ID NO: 2705)

tttcttggagtactctacgtctgagtgtcatttcttcaatgggacggagcgggtgcggttcctggaGagatacttc cataaccaggaggagaacgtgcgcttcgacagcgacgtgggggagtTccgggcggtgacggagctggggcggcctg atgccgagtactggaacagccagaaggacatcctggaagacGAgcgggccgcggtggacacctactgcagacacaa ctacggggttgtGgagagcttcacagtgcagcggcgag;

DRB1*1316:
(SEQ ID NO: 2706)

ggagtactctacgtctgagtgtcatttcttcaatgggacggagcgggtgcggttcctggacagatacttccataac caggaggagaacgtgcgcttcgacagcgacgtgggggagttccgggcggtgacggagctggggcggcctgatgccg agtactggaacagccagaaggacatcctggaagacgagcgggccgcggtggacacctactgcagacacaactacgg ggttgAtgagagcttcaca;

DRB1*1317:
(SEQ ID NO: 2707)

ggggacaccagaccacgtttcttggagtactctacgggtgagtgtTatttcttcaatgggacggagcgggtgcggt tcctggacagatacttctataaccaagaggagtacgtgcgcttcgacagcgacgtgggggagttccgggcggtgac ggagctggggcggcctgatgccgagtactggaacagccagaaggacatcctggaagacgAgcgggccgcggtggac acctactgcagacacaactacggggttgtGgagagcttcacagtgcagcggcgag;

DRB1*1318:
(SEQ ID NO: 2708)

cacgtttcttggagtactctacgtctgagtgtcatttcttcaatgggacggagcgggtgcggttcctggacagata cttccataaccaggaggagAacgtgcgcttcgacagcgacgtgggggagtTccgggcggtgacggagctggggcgg cctgatgccgagtactggaacagccagaaggacTtcctggaagacaggcgggcccTggtggacacctactgcagac acaactacggggttgtGgagagcttcacagtgcagcggcgag;

DRB1*1319:
(SEQ ID NO: 2709)

ggggacaccagaccacgtttcttggagtactctacgtctgagtgtcatttcttcaatgggacggagcgggtgcggt tcctggaGagatacttccataaccaggaggagtTcgtgcgcttcgacagcgacgtgggggagtaccgggcggtgac ggagctggggcggcctgatgccgagtactggaacagccagaaggacatcctggaagacGAgcgggccgcggtggac acctactgcagacacaactacggggttgtGgagagcttcacagtgcagcggcgag;

DRB1*1320:
(SEQ ID NO: 2710)

cacgtttcttggagtactctacgtctgagtgtcatttcttcaatgggacggagcgggtgcggttcctggaCagata cttccataaccaggaggagAAcgtgcgcttcgacagcgacgtgggggagtTccgggcggtgacggagctggggcgg cctgatgccgagtactggaacagccagaaggacctcctggaagacGAgcgggccgcggtggacacctactgcagac acaactacggggttgtGgagagcttcacagtgcagcgg;

DRB1*1321:
(SEQ ID NO: 2711)
ggggacaccagaccacgtttcttggagtactctacgtCtgagtgtcatttcttcaatgggacggagcgggtgcggt tcctggacagatacttctataaccaagaggagtacgtgcgcttcgacagcgacgtgggggagtTccgggcggtgac ggagctggggcggcctaGcgccgagtactggaacagccagaaggacTtcctggaagaCaggcgggccgcggtggac acctactgcagacacaactacggggttggtgagagcttcacagtgcagcggcgag;

DRB1*1322:
(SEQ ID NO: 2712)
gaccacgtttcttggagtactctacgtCtgagtgtcatttcttcaatgggacggagcgggtgcggttcctggaCag atacttctataaccaagaggagtAcgtgcgcttcgacagcgacgtgggggagtTccgggcggtgacggagctgggg cggcctgatgccgagtactggaacagccagaaggacAtcctggaagacGAgcgggccgcggtggacacctactgca gacacaactacggggttgtGgagagcttcacagtgcagcggcgag;

DRB1*1323:
(SEQ ID NO: 2713)
cgtttcttggagtactctacgtctgagtgtcatttcttcaatgggacggagcgggtgcggttcctggacagatact tctataaccaagaggagtacgtgcgcttcgacagcgacgtgggggagttccgggcggtgacggagctggggcggcc tgatgccgagtactggaacagccagaaggacatcctggaagacGAgcgggccgcggtggacacctactgcagacac aactacggggttggtgagagcttcacGgtgcagcggc;

DRB1*1324:
(SEQ ID NO: 2714)
cgtttcttggagtactctacgtctgagtgtcatttcttcaatgggacggagcgggtgcggttcctggacagatact tctataaccaagaggagtacgtgcgcttcgacagcgacgtgggggagtTccgggcggtgacggagctggggcggcc tgatgccgagtactggaacagccagaaggacTtcctggaagacGAgcgggccgcggtggacacctactgcagacac aactacggggttgtGgagagcttcacagtgcagcggc;

DRB1*1325:
(SEQ ID NO: 2715)
cacgtttcttggagtactCtaCgtCtgaGtgtcatttcttcaatgggacggagcgggtgcggttcctggaCagata cttctataaccaagaggagtAcgtgcgcttcgacagcgacgtgggggagtTccgggcggtgacggagctggggcgg cctgatgccgagtactggaacagccagaaggacctcctggaagaCaggcgggccgcggtggacacctactgcagac acaactacggggttggtgaga;

DRB1*1326:
(SEQ ID NO: 2716)
cacgtttcttggagtactctacgtctgagtgtcatttcttcaatgggacggagcgggtgcggttcctggagagata cttcCataaccaGgaggagAAcgtgcgcttcgacagcgacgtgggggagtaccgggcggtgacggagctggggcgg cctgacgcTgagtactggaacagccagaaggacTtcctggaaGaCaggcgCgccgcggtggacacctactgcagac acaactacggggttggtgagagcttcacagtgcagcggcgag;

DRB1*1327:
(SEQ ID NO: 2717)
cacgtttcttggagtactctacgtctgagtgtcatttcttcaatgggacggagcgggtgcggtAcctggacagata cttccataaccaggaggagaacgtgcgcttcgacagcgacgtgggggagttccgggcggtgacggagctggggcgg cctgatgccgagtactggaacagccagaaggacatcctggaagacGAgcgggccgcggtggacacctactgcagac acaactacggggttgtGgagagcttcacagtgcagcggcgag;

DRB1*1328:
(SEQ ID NO: 2718)
ttggagtactctacgtctgagtgtcatttcttcaatgggacggagcgggtgcggttcctggacagatacttccata accaggaggagaacgtgcgcttcgacagcgacgtgggggagttccgggcggtgacggagctggggcggcctgatgc cgagtactggaacagccagaaggacatcctggaagacgagcgggccgcggtggacacctactgcagacacaactac Cggggttgtggagagcttcac;

DRB1*1329:
(SEQ ID NO: 2719)
cacgtttcttggagtactctacgtctgagtgtcatttcttcaatgggacggagcgggtgcggttcctggaCagata cttccataaccaggaggagAAcgtgcgcttcgacagcgacgtgggggagtTccgggcggtgacggagctggggcgg cctgatgccgagtactggaacagccagaaggacctcctggaagacGAgcgggccgcggtggacacctactgcagac acaactacggggttggtgagagcttcacagtgcagcggcgag;

DRB1*1330:
(SEQ ID NO: 2720)
tttcttggagtactctacgtctgagtgtcatttcttcaatgggacggagcgggtgcggttcctggacagatacttc tataaccaagaggagtacgtgcgcttcgacagcgacgtgggggagtTccgggcggtgacggagctggggcggccta GcgccgagtactggaacagccagaaggacAtcctggaagaCaggcgggccgcggtggacacctactgcagacacaa ctacggggttggtgagagcttcaca;

DRB1*1331:
(SEQ ID NO: 2721)
cacgtttcttggagtactctacgtctgagtgtcatttcttcaatgggacggagcgggtgcggttcctggacagata cttccataaccaggaggagaacgtgcgcttcgacagcgacgtgggggagttccgggcggtgacggagctggggcgg cctgTcgccgagtactggaacagccagaaggacAtcctggaagacGAgcgggccgcggtggacacctactgcagac acaactacggggttggtgagagcttcacagtgcagcggcga;

DRB1*1332:
(SEQ ID NO: 2722)
cacgtttcttggagtactctacgtctgagtgtcatttcttcaatgggacggagcgggtgcggttcctggacagata cttccataaccaggaggagAacgtgcgcttcgacagcgacgtgggggagtaccgggcggtgacggagctggggcgg cctaGcgccgagtactggaacagccagaaggacatcctggaagacGAgcgggccgcggtggacacctactgcagac acaactacggggttgtGgagagcttcacagtgcagcggcgag;

DRB1*1333:
(SEQ ID NO: 2723)
cacgtttcttggagtactctacgtctgagtgtcatttcttcaatgggacggagcgggtgcggttcctggacagata cttctataaccaagaggagtacgtgcgcttcgacagcgacgtgggggagtaccgggcggtgacggagctggggcgg cctaGcgccgagtactggaacagccagaaggacatcctggaagaCaagcgggccgcggtggacaActactgcagac acaactacggggttggtg;

DRB1*1334:
(SEQ ID NO: 2724)
cacgtttcttggagtactctacgtctgagtgtcatttcttcaatgggacggagcgggtgcggttcctggacagata cttccataaccaggaggagaacCtgcgcttcgacagcgacgtgggggagttccgggcggtgacggagctggggcgg cctgatgccgagtactggaacagccagaaggacatcctggaagacGAgcgggccgcggtggacacctactgcagac acaactacggggttggtgagagcttcacagtgcagcggcgag;

DRB1*1335:
(SEQ ID NO: 2725)
cacgtttcttggagtactctacgtctgagtgtcatttcttcaatgggacggagcgggtgcggttcctggacagata cttccataaccaggaggagaacgtgcgcttcgacagcgacgtgggggagttccTggcggtgacggagctggggcgg cctgatgccgagtactggaacagccagaaggacatcctggaagacgagcgggccgcggtggacacctactgcagac acaactacggggttgtggagagcttcacagtgcagcgg;

DRB1*1336:
(SEQ ID NO: 2726)
cacgtttcttggagtactctacgtctgagtgtcatttcttcaatgggacggagcgggtgcggttcctggaCagata cttccataaccaggaggagAAcgtgcgcttcgacagcgacgtgggggagtaccgggcggtgacggagctggggcgg cctgatgccgagtactggaacagccagaaggacAtcctggaagacGAgcgggccgcggtggacacctactgcagac acaactacggggttggtgagagcttcacagtgcagcggcgag;

DRB1*1337:

(SEQ ID NO: 2727)

cacgtttcttggagtactctacgtctgagtgtcatttcttcaatgggacggagcgggtgcggttcctggacagata cttctataaccaagaggagtacgtgcgcttcgacagcgacgtgggggagtaccgggcggtgacggagctggggcgg cctgatgccgagtactggaacagccagaaggacatcctggaagaCaAgcgggccgcggtggacacctactgcagac acaactacggggttggtgagagcttcacGgtgcagcggcga;

DRB1*1338:

(SEQ ID NO: 2728)

cacgtttcttggagtactctacgtctgagtgtcatttcttcaatgggacggagcgggtgcggttcctggacagata cttctataaccaagaggagtacgtgcgcttcgacagcgacgtgggggagtaccgggcggtgacggagctggggcgg cctaGcgccgagtactggaacagccagaaggacatcctggaagacGAgcgggccgcggtggacacctactgcagac acaactacggggttggt;

DRB1*1339:

(SEQ ID NO: 2729)

cacgtttcttggagtactctacgtctgagtgtcatttcttcaatgggacggagcgggtgcggttcctggacagata cttccataaccaggaggagaacgtgcgcttcgacagcgacgtgggggagttccgggcggtgacggagctggggcgg cctgatgccgagtCctggaacagccagaaggacAtcctggaagacGAgcgggccgcggtggacacctactgcagac acaactacggggttggtgagagcttcacagtgcagcggcgag;

DRB1*1340:

(SEQ ID NO: 2730)

ttggagtactctacgtctgagtgtcatttcttcaatgggacggagcgggtgcggttcctggaCagatacttccata accaggaggagAAcgtgcgcttcgacagcgacgtgggggagtaccgggcggtgacggagctggggcggcctgatgc cgagtactggaacagccagaaggacAtcctggaagacGAgcgggccgcggtggacacctactgcagacacaactac ggggttgtGgagagcttcacagtgcagcggcg;

DRB1*1341:

(SEQ ID NO: 2731)

cacgtttcttggagtactctacgtctgagtgtcatttcttcaatgggacggagcgggtgcggtAcctggacagata cttccataaccaggaggagaacgtgcgcttcgacagcgacgtgggggagttccgggcggtgacggagctggggcgg cctgatgccgagtactggaacagccagaaggacatcctggaagacGAgcgggccgcggtggacacctactgcagac acaactacggggttggtgagagcttcacagtgcagcggcgag;

DRB1*1342:

(SEQ ID NO: 2732)

cacgtttcttggagtactctacgtctgagtgtcatttcttcaatgggacggagcgggtgcggttcctggacagata cttccataaccaggaggagAacgtgcgcttcgacagcgacgtgggggagttccgggcggtgacggagctggggcgg cctgatgccgagtactggaacagccagaaggacTtcctggaagaCaggcgggccgcggtggacacctactgcagac acaactacggggttgtGgagagcttcacagtgcagcggcgag;

DRB1*1343:

(SEQ ID NO: 2733)

cacgtttcttggagtactctacgtctgagtgtcatttcttcaatgggacggagcgggtgcggttcctggacagata cttccataaccaggaggagaacgtgcgcttcgacagcgacgtgggggagtTccggcggtgacggagctggggcgg cctgCtgcggagcactggaacagccagaaggacctcctggaagacGAgcgggccgcggtggacacctactgcagac acaactacggggttgtGgagagcttcacagtgcagcggcga;

DRB1*1344:

(SEQ ID NO: 2734)

cacgtttcttggagtactctacgtCtgaGtgtcatttcttcaatgggacggagcgggtgcggttcctggaCagata cttctataaccaagaggagtAcgtgcgcttcgacagcgacgtgggggagtTccgggcggtgacggagctggggcgg

DRB1*1345:

(SEQ ID NO: 2735)

ttggagtactctacgtctgagtgtcatttcttcaatgggacggagcgggtgcggttcctggacagatacttctata accaagaggagtacgtgcgcttcgacagcgacgtgggggagtTccgggcggtgacggagctggggcggcctgCtgc ggagcactggaacagccagaaggacAtcctggaagacGAgcgggccgcggtggacacctactgcagacacaactac ggggttggtgagag;

DRB1*1346:

(SEQ ID NO: 2736)

cacgtttcttggagtactctacgtctgagtgtcatttcttcaatgggacggagcgggtgcggttcctggacagata cttctataaccaagaggagtAcgtgcgcttcgacagcgacgtgggggagttccgggcggtgacggagctggggcgg cctgTCgccgagtactggaacagccagaaggacTtcctggaAgaCaggcgggccgcggtggacacctactgcagac acaactacggggttggtgagagcttcacagtgcagcggcgag;

DRB1*1347:

(SEQ ID NO: 2737)

cacgtttcttggagtactctacgtCtgagtgtcatttcttcaatgggacggagcgggtgcggttcctggacagata cttctataaccaagaggagtAcgtgcgcttcgacagcgacgtgggggagtaccggcggtgacggagctggggcgg cctgatgccgagtactggaacagccagaaggacTtcctggaagacaggcgggcccTggtggacacctactgcagac acaactacggggttggtgagagcttcacGgtgcagcggcgag;

DRB1*1348:

(SEQ ID NO: 2738)

cacgtttcttggagtactctacgtctgagtgtcatttcttcaatgggacggagcgggtgcggttcctggacagata cttctataaccaagaggagtacgtgcgcttcgacagcgacgtgggggagtaccgggcggtgacggagctggggcgg cctaGcgccgagtactggaacagccagaaggacatcctggaagacGAgcgggccgcggtggacacctactgcagac acaactacggggttgtGgagagcttcacagtgcagcggcgag;

DRB1*1349:

(SEQ ID NO: 2739)

cacgtttcttggagtactctacgtCtgagtgtcatttcttcaatgggacggagcgggtgcggttcctggacagata cttctataaccaagaggagtacgtgcgcttcgacagcgacgtgggggagtaccgggcggtgacggagctggggcgg cctaGcgccgagtactggaacagccagaaggacTtcctggaagaCaggcgggccgcggtggacacctactgcagac acaactacggggttggtgagagcttcacagtgcagcgg;

DRB1*1350:

(SEQ ID NO: 2740)

cacgtttcttggagtactctacgtctgaGtgtcatttcttcaatgggacggagcgggtgcggttcctggacagata cttctataaccaagaggagAacgtgcgcttcgacagcgacgtgggggagtTccgggcggtgacggagctggggcgg cctgatgccgagtactggaacagccagaaggacTtcctggaagaCaggcgggccgcggtggacacctactgcagac acaactacggggttggtgagagcttcacagtgcagcggcgag;

DRB1*1351:

(SEQ ID NO: 2741)

cacgtttcttggagtactctacgtctgagtgtcatttcttcaatgggacggagcgggtgcggttcctggacagata cttccataaccaggaggagaacgtgcgcttcgacagcgacgtgggggagttccgggcgTtgacggagctggggcgg cctgatgccgagtactggaacagccagaaggacatcctggaagacgagcgggccgcggtggacacctactgcagac acaactacggggttgtggagagcttcacagtgcagcggcgag;

DRB1*1352:

(SEQ ID NO: 2742)

cacgtttcttggagtactctacgtctgagtgtcatttcttcaatgggacggagcgggtgcggttcctggaCagata cttccataaccaGgaggagtAcgtgcgcttcgacagcgacgtgggggagtTccgggcggtgacggagctggggcgg

```
cctgatgccgagtactggaacagccagaaggacAtcctggaagacGAgcgggccgcggtggacacctactgcagac acaactacggggttgtGgagagcttcacagtg;
```

DRB1*1353:

(SEQ ID NO: 2743)
```
cacgtttcttggagtactctacgtctgagtgtcatttcttcaatgggacggagcgggtgcggttcctggaGagata cttccataaccaggaggagaAcgtgcgcttcgacagcgacgtgggggagtaccgggcggtgacggagctggggcgg cctgatgccgagtactggaacagccagaaggacatcctggaagacGAgcgggccgcggtggacacctactgcagac acaactacggggttgtGgagagcttcacagtgcagcggcga;
```

DRB1*1354:

(SEQ ID NO: 2744)
```
cacgtttcttggagtactctacgtctgagtgtcatttcttcaatgggacggagcgggtgcggttcctggacagata cttctataaccaagaggagtacgtgcgcttcgacagcgacgtgggggagttccgggcggtgacggagctggggcgg cctgtcgccgagtCctggaacagccagaaggacttcctggaagacGAgcgggccgcggtggacacctactgcagac acaactacggggttgtGgagagcttcacagtgcagcggcgag;
```

DRB1*1355:

(SEQ ID NO: 2745)
```
tttcttggagtactctacgtCtgagtgtcatttcttcaatgggacggagcgggtgcggttcctggacagatacttc tataaccaagaggagtacgtgcgcttcgacagcgacgtgggggagtaccgggcggtgacggagctggggcggccta gCgccgagtactggaacagccagaaggacTtcctggaagacaggcgggcccTggtggacacctactgcagacacaa ctacggggttggtgagagcttcacGgtgcagcggcgag;
```

DRB1*140101:

(SEQ ID NO: 2746)
```
atggtgtgtctgaggctccctggaggctcctgcatggcagTtctgacagtgacactgatggtgctgagctccccac tggctttggctggggacaccagaccacgtttcttggagtactctacgtCtgagtgtcatttcttcaatgggacgga gcgggtgcggttcctggacagatacttccataaccaggaggagttcgtgcgcttcgacagcgacgtgggggagtac cgggcggtgacggagctggggcggcctgctgcggagcactggaacagccagaaggacctcctggagcggaggcggg ccgAggtggacacctaTtgcagacacaactacggggttgtGgagagcttcacagtgcagcggcgag;
```

DRB1*140102:

(SEQ ID NO: 2747)
```
cacgtttcttggagtacTctacgtCtgagtgtcatttcttcaatgggacggagcgggtgcggttcctggacagata cttccataaccaggaggagttcgtgcgcttcgacagcgacgtgggggagtaccgggcggtgacggagctggggcgg cctgCtgcggagcactggaacagccagaaggacctcctggagcggaggcgggccgAggtggacacctactgcagac acaactacggggttgtGg;
```

DRB1*1402:

(SEQ ID NO: 2748)
```
atggtgtgtctgaggctccctggaggctcctgcatggcagTtctgacagtgacactgatggtgctgagctccccac tggctttggctggggacaccagaccacgtttcttggagtactctacgtctgagtgtcatttcttcaatgggacgga gcgggtgcggttcctggagagatacttccataaccaGgaggagAAcgtgcgcttcgacagcgacgtgggggagtac cgggcggtgacggagctggggcggcctgatgccgagtactggaacagccagaaggacctcctggagcagaggcggg ccgcggtggacacctactgcagacacaactacggggttggtgagagcttcacagtgcagcggcgag;
```

DRB1*1403:

(SEQ ID NO: 2749)
```
atggtgtgtctgaggctccctggaggctcctgcatggcagTtctgacagtgacactgatggtgctgagctccccac tggctttggctggggacaccagaccacgtttcttggagtactctacgtctgagtgtcatttcttcaatgggacgga gcgggtgcggttcctggagagatacttccataaccaggaggagAacgtgcgcttcgacagcgacgtgggggagtac cgggcggtgacggagctggggcggcctgatgccgagtactggaacagccagaaggacctcctggaagacaggcggg cccTggtggacacctactgcagacacaactacggggttggtgagagcttcacagtgcagcggcgag;
```

DRB1*1404:

(SEQ ID NO: 2750)

atggtgtgtctgaggctccctggaggctcctgcatggcagTtctgacagtgacactgatggtgctgagctccccac tggctttggctggggacaccagaccacgtttcttggagtactctacgggtgagtgtTatttcttcaatgggacgga gcgggtgcggttcctggacagatacttccataaccaggaggagttcgtgcgcttcgacagcgacgtgggggagtac cgggcggtgacggagctggggcggcctgctgcggagcactggaacagccagaaggacctcctggagcggaggcggg ccgAggtggacacctaTtgcagacacaactacggggttgtGgagagcttcacagtgcagcggcgag;

DRB1*140501:

(SEQ ID NO: 2751)

cacgtttcttggagtactctacgtctgagtgtcaAttcttcaatgggacggagcgggtgcggttcctggacagata cttccataaccaggaggagttcgtgcgcttcgacagcgacgtgggggagtaccgggcggtgacggagctggggcgg cctgatgcTgagtactggaacagccagaaggacctcctggagcggaggcgggccgaggtggacacctaTtgcagac acaactacggggttgtGgagagcttcacagtgcagcggcgag;

DRB1*140502:

(SEQ ID NO: 2752)

cacgtttcttggagtactctacgtctgagtgtcaAttcttcaatgggacggagcgggtgcggttcctggacagata cttccataaccaggaggagttcgtgcgcttcgacagcgacgtgggggagtaccgggcggtgacggagctggggcgg cctgatgccgagtactggaacagccagaaggacctcctggagcggaggcgggccgaggtggacacctaTtgcagac acaactacggggttgtGgagagcttcacagtgcagcggcgag;

DRB1*1406:

(SEQ ID NO: 2753)

cacgtttcttggagtactctaCgtctgagtgtcatttcttcaatgggacggagcgggtgcggttcctggaGagata cttccataaccaggaggagAAcgtgcgcttcgacagcgacgtgggggagtaccgggcggtgacggagctggggcgg cctgatgccgagtactggaacagccagaaggacctcctggagcagaggcgggccgcggtggacacctactgcagac acaactacggggttgtGgagagcttcacagtgcagcggcgag;

DRB1*140701:

(SEQ ID NO: 2754)

cacgtttcttggagtacTctacgtCtgagtgtcatttcttcaatgggacggagcgggtgcggttcctggacagata cttccataaccaggaggagttcgtgcgcttcgacagcgacgtgggggagtaccgggcggtgacggagctggggcgg cctgCtgcggagcactggaacagccagaaggacctcctggagcggaggcgggccgAggtggacacctaTtgcagac acaactacggggttggtgagagcttcacagtgcagcggcga;

DRB1*140702:

(SEQ ID NO: 2755)

cacgtttcttggagtactctacgtctgagtgtcatttcttcaatgggacggagcgggtgcggttcctggacagata cttccataaccaggaggagttcgtgcgcttcgacagcgacgtgggggagtaccgggcggtgacggagctggggcgg cctgCtgcggagcactggaacagccagaaggacctcctggagcggaggcgggccgaggtggacacctaTtgcagac acaactacggggttggtgagagcttcacGgtgcagcggcgag;

DRB1*1408:

(SEQ ID NO: 2756)

cacgtttcttggagtacTctacgtCtgagtgtcatttcttcaatgggacggagcgggtgcggttcctggacagata cttccataaccaggaggagttcgtgcgcttcgacagcgacgtgggggagtaccgggcggtgacggagctggggcgg cctgatgcggagCactggaacagccagaaggacctcctggagcggaggcgggccgAggtggacacctaTtgcagac acaactacggggttgtGgagagcttcacagtgcagcggcga;

DRB1*1409:

(SEQ ID NO: 2757)

tttcttggagtactctaCgtctgaGtgtcatttcttcaatgggacggagcgggtgcggttcctggaCagatacttc

CataaccaGgaggagAAcgtgcgcttcgacagcgacgtgggggagtaccgggcggtgacggagctggggcggcctg atgccgagtactggaacagccagaaggacctcctggagcagaggcgggccgcggtggacacctactgcagacacaa ctacggggttggtgagagcttcacagtgcagcggcgag;

DRB1*1410:
(SEQ ID NO: 2758)
ttcttggagcaggttaaacAtgagtgtcatttcttcaatgggacggagcgggtgcggttcctggacagatacttcc ataaccaggaggagttcgtgcgcttcgacagcgacgtgggggagtaccgggcggtgacggagctggggcggcctgC tgcggagcactggaacagccagaaggacctcctggagcggaggcgggccgAggtggacacctaTtgcagacacaac tacggggttgtGgagagcttcacagtgcagcgg;

DRB1*1411:
(SEQ ID NO: 2759)
gagtactctacggGtgagtgtTatttcttcaatgggacggagcgggtgcggttcctggacagatacttccataacc aggaggagttcgtgcgcttcgacagcgacgtgggggagtaccgggcggtgacggagctggggcggcctgatgAGga gtactggaacagccagaaggacctcctggagcggaggcgggccgAggtggacacctaTtgcagacacaactacggg gttgtGg;

DRB1*1412:
(SEQ ID NO: 2760)
gtctgagtgtcatttcttcaatgggacggagcgggtgcggttcctggaGagatacttccataaccaggaggagAAc gtgcgcttcgacagcgacgtgggggagtaccgggcggtgacggagctggggcggcctgatgccgagtactggaaca gccagaaggacctcctggaagacaggcgggcccTggtggacacctactgcagacacaactacggggttgtGg;

DRB1*1413:
(SEQ ID NO: 2761)
gagtactctacgtctgagtgtcatttcttcaatgggacggagcgggtgcggttcctggaGagatacttccataacc aggaggagAAcgtgcgcttcgacagcgacgtgggggagtaccgggcggtgacggagctggggcggcctaGcgccga gtactggaacagccagaaggacctcctggagcagaggcgggccgcggtggacacctactgcagacacaactacggg gttggtg;

DRB1*1414:
(SEQ ID NO: 2762)
ttcttggagtactctacgtCtgagtgtcatttcttcaatgggacggagcgggtgcggttcctggacagatacttcc ataaccaggaggagtTcgtgcgcttcgacagcgacgtgggggagtaccgggcggtgacggagctggggcggcctga tgccgagtactggaacagccagaaggacctcctggagcggaggcgggccgAggtggacacctaTtgcagacacaac tacggggttggtgagagcttcacagtg;

DRB1*1415:
(SEQ ID NO: 2763)
ctctacggGtgagtgtTatttcttcaatgggacggagcgggtgcggttcctggacagatacttccataaccaggag gagtTcgtgcgcttcgacagcgacgtgggggagtaccgggcggtgacggagctggggcggcctgatgccgagtact ggaacagccagaaggacTtcctggaagacaggcgggcccTggtggacacctactgcagacacaactacggggttgt Ggagagcttcacagtgcag;

DRB1*1416:
(SEQ ID NO: 2764)
ttggagtactctacgtctgagtgtcatttcttcaatgggacggagcgggtgcggttcctggacagatacttccata accaggaggagttcgtgcgcttcgacagcgacgtgggggagtaccgggcggtgacggagctggggcggcctgCtgc ggagcactggaacagccagaaggacAtcctggaagacGAgcgggccgcggtggacacctactgcagacacaactac ggggttgtGgag;

DRB1*1417:
(SEQ ID NO: 2765)
cacgtttcttggagtactctacgtctgaGtgtcatttcttcaatgggacggagcgggtgcggttcctggaCagata cttcCataaccaggaggagAacgtgcgcttcgacagcgacgtgggggagtTccgggcggtgacggagctggggcgg cctgatgccgagtactggaacagccagaaggacctcctggagcagaggcgggccgcggtggacacctactgcagac acaactacggggttgtGgagagcttcacagtgcagcgg;

DRB1*1418:
(SEQ ID NO: 2766)
gagtactctacgtctgagtgtcatttcttcaatgggacggagcgggtgcggttcctggagagatacttccataacc aggaggagAAcgtgcgcttcgacagcgacgtgggggagtaccgggcggtgacggagctggggcggcctgatgcTga gtactggaacagccagaaggacctcctggagcggaggcgggccgAggtggacacctaTtgcagacacaactacggg gttgtGgagagcttcacagtgcagcggcga;

DRB1*1419:
(SEQ ID NO: 2767)
ggggacaccagaccacgtttcttggAgtactctaCgtctgagtgtcatttcttcaatgggacggagcgggtgcggt tcctggaGagatacttccataaccaggaggagAAcgtgcgcttcgacagcgacgtgggggagtaccgggcggtgac ggagctggggcggcctgatgccgagtactggaacagccagaaggacctcctggagcagaAgcgggccgcggtggac acctactgcagacacaactacggggttggtgagagcttcaca;

DRB1*1420:
(SEQ ID NO: 2768)
ttggagtactctacgtCtgagtgtcatttcttcaatgggacggagcgggtgcggttCctggaGagatacttccata accaggaggagtTcgtgcgcttcgacagcgacgtgggggagtaccgggcggtgacggagctggggcggcctgatgc cgagtactggaacagccagaaggacctcctggagcagaggcgggccgcggtggacacctactgcagacacaactac ggggttgtGgaga;

DRB1*1421:
(SEQ ID NO: 2769)
ttggagtactctacgtctgagtgtcatttcttcaatgggacggagcgggtgcggttcctggaCagatacttcCata accaggaggagAacgtgcgcttcgacagcgacgtgggggagtTccgggcggtgacggagctggggcggcctgatgc cgagtactggaacagccagaaggacctcctggagcagaAgcgggccgcggtggacacctactgcagacacaactac ggggttgtGgaga;

DRB1*1422:
(SEQ ID NO: 2770)
cacgtttcttggagtactctacgtctgagtgtcatttcttcaatgggacggagcgggtgcggttcctggacagata cttccataaccaggaggagtTcgtgcgcttcgacagcgacgtgggggagtaccgggcggtgacggagctggggcgg cctgCtgcggagCactggaacagccagaaggacTtcctggaAgaCaggcgggccgcggtggacacctactgcagac acaactacggggttggtgagagcttcacagtgcagcggcgag;

DRB1*1423:
(SEQ ID NO: 2771)
cacgtttcttggagtacTctacgtCtgagtgtcatttcttcaatgggacggagcgggtgcggttcctggacagata cttccataaccaggaggagtTcgtgcgcttcgacagcgacgtgggggagtaccgggcggtgacggagctggggcgg cctgatgccgagtactggaacagccagaaggacctcctggagcggaggcgggccgAggtggacacctaTtgcagac acaactacggggttgtGgagagcttcacagtgcagcggcgag;

DRB1*1424:
(SEQ ID NO: 2772)
ttcttggagtactctacgtctgagtgtcatttcttcaatgggacggagcgggtgcggttcctggaGagatacttcc ataaccaGgaggagAAcgtgcgcttcgacagcgacgtgggggagtaccgggcggtgacggagctggggcggcctga tgccgagtactggaacagccagaaggacAtcctggagcagGCgcgggccgcggtggacacctactgcagacacaac tacggggttggtgagagcttcacagtgcagcggcgag;

DRB1*1425:
(SEQ ID NO: 2773)
tttcttggagtactctacgtCtgagtgtcatttcttcaatgggacggagcgggtgcggttcctggacagatacttc cataaccaagaggagtAcgtgcgcttcgacagcgacgtgggggagtaccgggcggtgacggagctggggcggcctg CtgcggagCactggaacagccagaaggacTtcctggaAgaCaggcgggccgcggtggacacctactgcagacacaa ctacggggttggtgagagcttcacagtgcagcggcgag;

DRB1*1426:
(SEQ ID NO: 2774)
cacgtttcttggagtactctacgtctgagtgtcatttcttcaatgggacggagcgggtgcAgttcctggacagata
cttccataaccaggaggagttcgtgcgcttcgacagcgacgtgggggagtaccgggcggtgacggagctggggcgg
cctgctgcggagcactggaacagccagaaggacctcctggagcggaggcgggccgaggtggacacctattgcagac
acaactacggggttgtGgagagcttcacagtgcagcggcgag;

DRB1*1427:
(SEQ ID NO: 2775)
cacgtttcttggagtactctacgtctgagtgtcatttcttcaatgggacggagcgggtgcggttcctggaGagata
cttccataaccaggaggagAAcgtgcgcttcgacagcgacgtgggggagtaccgggcggtgacggagctggggcgg
cctgatgccgagtactggaacagccagaaggacTtcctggaagaCaggcgggccCTggtggacacctactgcagac
acaactacggggttggtgagagcttcacagtgcagcggcgag;

DRB1*1428:
(SEQ ID NO: 2776)
cacgtttcttggagtactctacgggtgagtgttatttcttcaatgggacggagcgggtgcggttcctggacagata
cttccataaccaggaggagttcgtgcgcttcgacagcgacgtgggggagtaccgggcggtgacggagctggggcgg
cctgCtgcggagcactggaacagccagaaggacctcctggagcggaggcgggccgaggtggacacctattgcagac
acaactacggggCtgtGgagagcttcaca;

DRB1*1429:
(SEQ ID NO: 2777)
cacgtttcttggagtactctacgtctgagtgtcatttcttcaatgggacggagcgggtgcggttcctggaGagata
cttccataaccaGgaggagAAcgtgcgcttcgacagcgacgtgggggagtaccgggcggtgacggagctggggcgg
cctgatgccgagtactggaacagccagaaggacctcctggagcagaggcgggccgcggtggacacctactgcagac
acaactacggggCtgtggagagcttcacagtgcagcggcgag;

DRB1*1430:
(SEQ ID NO: 2778)
tttcttggagtactctacgtctgaGtgtcatttcttcaatgggacggagcgggtgcggttcctggaCagatacttc
CataaccaGgaggagAacgtgcgcttcgacagcgacgtgggggagtTccgggcggtgacggagctggggcggcctg
atgccgagtactggaacagccagaaggacctcctggagcagaggcgggccgcggtggacacctactgcagacacaa
ctacggggttggtgagagcttcaca;

DRB1*1431:
(SEQ ID NO: 2779)
tttcttggagtactctacgggtgagtgtTatttcttcaatgggacggagcgggtgcggttcctggacagatacttc
cataaccaggaggagttcgtgcgcttcgacagcgacgtgggggagtaccgggcggtgacggagctggggcggcctg
CtgcggagcactggaacagccagaaggacctcctggagcggaggcgggccgcggtggacacctaTtgcagacacaa
ctacggggttgtGgagagcttcaca;

DRB1*1432:
(SEQ ID NO: 2780)
cacgtttcttggagtacTctacgtCtgagtgtcatttcttcaatgggacggagcgggtgcggttcctggacagata
cttccataaccaggaggagttcgtgcgcttcgacagcgacgtgggggagtaccgggcggtgacggagctggggcgg
cctgCtgcggagcactggaacagccagaaggacctcctggagcGgaggcgggccgcggtggacacctactgcagac
acaactacggggttgtGgagagcttcacagtgcagcggcgag;

DRB1*1433:
(SEQ ID NO: 2781)
ttggagtactctacgtctgagtgtcatttcttcaatgggacggagcgggtgcggttcctggacagatacttccata
accaggaggagaAcgtgcgcttcgacagcgacgtgggggagtTccgggcggtgacggagctggggcggcctgatgc
cgagtactggaacagccagaaggacctcctggagcagaggcgggccgAggtggacacctactgcagacacaactac
ggggttgtGgagagcttcacagtgcagcggc;

-continued

DRB1*1434:
(SEQ ID NO: 2782)
cacgtttcttggagtacTctacgtCtgagtgtcatttcttcaatgggacggagcgggtgcggttcctggacagata
cttccataaccaggaggagttcgtgcgcttcgacagcgacgtgggggagtaccgggcggtgacggagctggggcgg
cctgatgcggagCactggaacagccagaaggacctcctggagcggaggcgggccgcggtggacacctaTtgcagac
acaactacggggttgtGgagagcttcacagtgcagcggcgag;

DRB1*1435:
(SEQ ID NO: 2783)
cacgtttcttggagtactctacgtctgagtgtcatttcttcaatgggacggagcgggtgcggttcctggacagata
cttccataaccaggaggagttcgtgcgcttcgacagcgacgtgggggagtTccgggcggtgacggagctggggcgg
cctgCtgcggagcactggaacagccagaaggacctcctggagcggaggcgggccgAggtggacacctaTtgcagac
acaactacggggttgtGgagagcttcacagtgcagcgg;

DRB1*1436:
(SEQ ID NO: 2784)
cacgtttcttggagtactctacgtctgagtgtcatttcttcaatgggacggagcgggtgcggttcctggacagata
cttccataaccaggaggagttcgtgcgcttcgacagcgacgtgCgggagtaccgggcggtgacggagctggggcgg
cctgatgccgagtactggaacagccagaaggacctcctggagcggaggcgggccgaggtggacacctaTtgcagac
acaactacggggttggtgagagcttcacagtgcagcggcgag;

DRB1*1437:
(SEQ ID NO: 2785)
cacgtttcttggagtactctacgtctgagtgtcaAttcttcaatgggacggagcgggtgcggttcctggacagata
cttccataaccaggaggagttcgtgcgcttcgacagcgacgtgggggagtaccgggcggtgacggagctggggcgg
cctgatgctgagtactggaacagccagaaggacatcctggagcaggCgcgggccgcggtggacacctactgcagac
acaactacggggttgtGgagagcttcacagtgcagcggcgag;

DRB1*1438:
(SEQ ID NO: 2786)
cacgtttcttggagtactctacgtctgagtgtcatttcttcaatgggacggagcgggtgcggttcctggacagata
cttccataaccaggaggagttcgtgcgcttcgacagcgacgtgggggagtaccgggcggtgacggagctggggcgg
cctgCtgcggagcactggaacagccagaaggacctcctggagcggaggcgggccgaggtggacaaTtactgcagac
acaactacggggttgtGgagagcttcacagtgcagcggcgag;

DRB1*1439:
(SEQ ID NO: 2787)
cacgtttcttggagtaccctacgtCtgagtgtcatttcttcaatgggacggagcgggtgcggttcctggacagata
cttccataaccaggaggagttcgtgcgcttcgacagcgacgtgggggagtaccgggcggtgacggagctggggcgg
cctgCtgcggagcactggaacagccagaaggacctcctggagcggaggcgggccgAggtggacacctaTtgcagac
acaactacggggttgtGgagagcttcacagtgcagcggcgag;

DRB1*1440:
(SEQ ID NO: 2788)
cacgtttcttggagtactctacgtctgagtgtcatttcttcaatgggacggagcgggtgcggttcctggaGagata
cttccataaccaggaggagtTcgtgcgcttcgacagcgacgtgggggagtaccgggcggtgacggagctggggcgg
cctgatgccgagtactggaacagccagaaggacctcctggaagaCaggcgggccCTggtggacacctactgcagac
acaactacggggttggtgagagcttcacagtgcagcggcgag;

DRB1*1441:
(SEQ ID NO: 2789)
cacgtttcttggagtactctaCgtCtgagtgtcatttcttcaatgggacggagcgggtgcggttCctggaGagata
cttccataaccaggaggagtTcCtgcgcttcgacagcgacgtgggggagtaccgggcggtgacggagctggggcgg
cctgatgccgagtactggaacagccagaaggacctcctggagcagaggcgggccgcggtggacacctactgcagac
acaactacggggttggtgagagcttcacagtgcagcggcga;

-continued

DRB1*1442:
(SEQ ID NO: 2790)
cacgtttcttggagtactctacgtctgagtgtcatttcttcaatgggacggagcgggtgcggttcctggacagata cttctataaccaagaggagtAcgtgcgcttcgacagcgacgtgggggagtTccgggcggtgacggagctggggcgg cctgatgccgagtactggaacagccagaaggacctcctggagcggaggcgggccgAggtggacacctaTtgcagac acaactacggggttggtgagagcttcacagtgcagcggcgag;

DRB1*1443:
(SEQ ID NO: 2791)
cacgtttcttggagtactctacgtctgagtgtcaattcttcaatgggacggagcgggtgcggttcctggacagata cttccataaccaggaggagttcgtgcgcttcgacagcgacgtgggggagtaccgggcggtgacggagctggggcgg cctgatgctgagtactggaacagccagaaggacctcctggagcggaggcgggccgaggtggacGcctattgcagac acaactacggggttgtggagagcttcacagtgcagcggcgag;

DRB1*1444:
(SEQ ID NO: 2792)
cacgtttcttggagtactctacgtctgagtgtcaAttcttcaatgggacggagcgggtgcggttcctggacagata cttccataaccaggaggagttcgtgcgcttcgacagcgacgtgggggagtaccgggcggtgacggagctggggcgg cctgatgcTgagtactggaacagccagaaggacctcctggagcggaggcgggccgaggtggacacctaTtgcagac acaactacggggttggtgagagcttcacagtgcagcggcgag;

DRB1*1445:
(SEQ ID NO: 2793)
cacgtttcttggagtactctacgtctgagtgtcaAttcttcaatgggacggagcgggtgcggttcctggacagata cttccataaccaggaggagttcgtgcgcttcgacagcgacgtgggggagtaccgggcggtgacggagctggggcgg cctgatgctgagtactggaacagccagaaggacAtcctggagcggaggcgggccgaggtggacacctaTtgcagac acaactacggggttgtGgagagcttcacagtgcagcggcgag;

DRB1*150101:
(SEQ ID NO: 2794)
atggtgtgtctgaagctccctggaggctcctgcatgacagcgctgacagtgacactgatggtgctgagctccccac tggctttgTctggggacacccgaccacgtttcctgtggcagcctaagagggagtgtcatttcttcaatgggacgga gcgggtgcggttcctggacagatacttctataaccaggaggagtccgtgcgcttcgacagcgacgtgggggagttc cgggcggtgacggagctggggcggcctgacgctgagtactggaacagccagaaggacatcctggagcaggcgcggg ccgcggtggacacctactgcagacacaactacggggttgtggagagcttcacagtgcagcggcgag;

DRB1*150102:
(SEQ ID NO: 2795)
cacgtttcctgtggcagcctaagagggagtgtcatttcttcaatgggacggagcgggtgcggttcctggacagata cttctataaccaggaggagtccgtgcgcttcgacagcgacgtgggggagttccgggcggtgacggagctggggcgg cctgacgctgagtactggaacagccagaaggacatcctggagcaggcgcgggccgcggtggacacctactgcagac acaactacggAgttgtGgagagcttcacagtgcagcgg;

DRB1*150103:
(SEQ ID NO: 2796)
cacgtttcctgtggcagcctaagaGggagtgtcatttcttcaatgggacggagcgggtgcggttcctggacagata cttctataaccaggaggagtccgtgcgcttcgacagcgacgtgggggagttccgggcggtgacggagctggggcgg cctgacgctgagtactggaacagccagaaggacatcctggagcaggcgcgggccgcggtggacacctaTtgcagac acaactacggggttgtGgagagcttcacagtgcagcgg;

DRB1*150104:
(SEQ ID NO: 2797)
cacgtttcctgtggcagcctaagagGgagtgtcatttcttcaatgggacggagcgggtgcggttcctggacagata cttctataaccaggaggagtccgtgcgcttcgacagcgacgtgggggagtTccggcggtgacggagctggggcgg cctgatgccgagtactggaacagccagaaggacAtcctggagcaggCgcgggccgcggtggacacctactgcagac acaactacggggttgtGgagagcttcacagtgcagcggcgag;

DRB1*150201:

(SEQ ID NO: 2798)

ggggacacccgaccacgtttcctgtggcagcctaagagGgagtgtcatttcttcaatgggacggagcgggtgcggt tcctggacagatacttctataaccaggaggagtccgtgcgcttcgacagcgacgtgggggagtTccgggcggtgac ggagctggggcggcctgacgcTgagtactggaacagccagaaggacAtcctggagcaggCgcgggccgcggtggac acctactgcagacacaactacggggttggtgagagcttcacagtgcagcggcgag;

DRB1*150202:

(SEQ ID NO: 2799)

gagtgtcatttcttcaatgggacggagcgggtgcggttcctggacagatacttctataaccaggaggagtccgtgc gcttcgacagcgacgtgggggagtTccgggcggtgacggagctggggcggcctgatgccgagtactggaacagcca gaaggacAtcctggagcagGCgcgggccgcggtggacacctactgcagacacaactacggggttggtg;

DRB1*150203:

(SEQ ID NO: 2800)

cacgtttcctgtggcagcctaagagggagtgtcatttcttcaatgggacggagcgggtgcggttcctggacagata cttctataaTcaggaggagtccgtgcgcttcgacagcgacgtgggggagttccgggcggtgacggagctggggcgg cctgacgctgagtactggaacagccagaaggacatcctggagcaggcgcgggccgcggtggacacctactgcagac acaactacggggttggtg;

DRB1*1503:

(SEQ ID NO: 2801)

ggggacacccgaccacgtttcctgtggcagcctaagagGgagtgtcatttcttcaatgggacggagcgggtgcggt tcctggacagaCacttctataaccaggaggagtccgtgcgcttcgacagcgacgtgggggagtTccgggcggtgac ggagctggggcggcctgacgcTgagtactggaacagccagaaggacAtcctggagcaggCgcgggccgcggtggac acctactgcagacacaactacggggttgtGgagagcttcacagtgcagcggcgag;

DRB1*1504:

(SEQ ID NO: 2802)

ttcctgtggcagcctaagagGgagtgtcatttcttcaatgggacggagcgggtgcggttcctggacagatacttct ataaccaggaggagtccgtgcgcttcgacagcgacgtgggggagttccgggcggtgacggagctggggcggcctga cgctgagtactggaacagccagaaggacTtcctggagcaggCgcgggccgcggtggacacctactgcagacacaac tacggggttgtGgagagcttcacagtg;

DRB1*1505:

(SEQ ID NO: 2803)

ttcctgtggcagcctaagagGgagtgtcatttcttcaatgggacggagcgggtgcggttcctggacagatacttct ataaccaggaggagtccgtgcgcttcgacagcgacgtgggggagtTccgggcggtgacggagctggggcggcctga cgcTgagtactggaacagccagaaggacctcctggagcaggCgcgggccgcggtggacacctactgcagacacaac tacggggttgtGgagagcttcacagtgcagcgg;

DRB1*1506:

(SEQ ID NO: 2804)

ctgtggcagcctaagagggagtgtcatttcttcaatgggacggagcgggtgcggttcctggacagatacttctata accaggaggagtccgtgcgcttcgacagcgacgtgggggagttccgggcggCgacggagctggggcggcctgacgc tgagtactggaacagccagaaggacatcctggagcaggcgcgggccgcggtggacacctactgcagacacaactac ggggttgtggagagcttcacagtgcagcggcgag;

DRB1*1507:

(SEQ ID NO: 2805)

tttcctgtggcagcctaagagGgagtgtcatttcttcaatgggacggagcgggtgcggttcctggacagatacttc tataaccaggaggagtccgtgcgcttcgacagcgacgtgggggagtaccgggcggtgacggagctggggcggcctg acgcTgagtactggaacagccagaaggacAtcctggagcaggCgcgggccgcggtggacacctactgcagacacaa ctacggggttgtGgagagc;

DRB1*1508:
(SEQ ID NO: 2806)
cacgtttcctgtggcagcctaagagggagtgtcatttcttcaatgggacggagcgggtgcggttcctggacagata cttctataaccaggaggagtccgtgcgcttcgacagcgacgtgggggagttccgggcggtgacggagctggggcgg cctgacgctgagtactggaacagccagaagAacatcctggagcaggcgcgggccgcggtggacacctactgcagac acaactacggggttggtgagagcttcacagtgcagcggcgag;

DRB1*1509:
(SEQ ID NO: 2807)
cacgtttcctgtggcagcctaagagggagtgtcatttcttcaatgggacggagcgggtgcggttcctggacagata cttctataaccaggaggagtccgtgcgcttcgacagcgacgtgggggagttccAggcggtgacggagctggggcgg cctgacgctgagtactggaacagccagaaggacatcctggagcaggCgcgggccgcggtggacacctactgcagac acaactacggggttgtggagagcttcacagtgcagcggcgag;

DRB1*1510:
(SEQ ID NO: 2808)
gtttcctgtggcagcctaagagGgagtgtcatttcttcaatgggacggagcgggtgcggttcctggacagatactt ctataaccaggaggagtccgtgcgcttcgacagcgacgtgggggagttccgggcggtgacggagctggggcggcct gacgctgagtactggaacagccagaaggacatcctggaagacgAgcgggccgcggtggacacctactgcagacaca actacggggttgtGgagagc;

DRB1*1511:
(SEQ ID NO: 2809)
cacgtttcctgtggcagcctaagagGgagtgtcatttcttcaatgggacggagcgggtgcggttcctggacagata cttctataaccaggaggagtccgtgcgcttcgacagcgacgtgggggagtaccgggcggtgacggagctggggcgg cctgacgcTgagtactggaacagccagaaggacAtcctggagcaggCgcgggccgcggtggacacctactgcagac acaactacggggttggtgagagcttcacagtgcagcggcgag;

DRB1*1512:
(SEQ ID NO: 2810)
gcacgtttcctgtggcagcctaagagGgagtgtcatttcttcaatgggacggagcgggtgcggttcctggacagat acttctataaccaggaggagtccgtgcgcttcgacagcgacgtgggggagttccgggcggtgacggagctggggcg gcctaGCgccgagtactggaacagccagaaggacAtcctggagcaggCgcgggccgcggtggacacctactgcaga cacaactacggggttgtGgagagcttcacagtgcagcggcgag;

DRB1*1513:
(SEQ ID NO: 2811)
cacgtttcctgtggcagcctaagagGgagtgtcatttcttcaatgggacggagcgggtgcggttcctggacagata cttctataaccaggaggagtccgtgcgcttcgacagcgacgtgggggagtTccgggcggtgacggagctggggcgg cctgacgcTgagtactggaacagcca...ggacAtcctggagcaggCgcgggccgcggtggacacctactgcagac acaactacggggttgtGgagagcttcacagtgcagcgg;

DRB1*160101:
(SEQ ID NO: 2812)
atggtgtgtctgaagctccctggaggctcctgcatgacagcgctgacagtgacactgatggtgctgagctccccac tggctttggctggggacacccgaccacgtttcctgtggcagcctaagagGgagtgtcatttcttcaatgggacgga gcgggtgcggttcctggacagatacttctataaccaggaggagtccgtgcgcttcgacagcgacgtgggggagtac cgggcggtgacggagctggggcggcctgacgctgagtactggaacagccagaaggacTtcctggaagacaggcgCg ccgcggtggacacctactgcagacacaactacggggttggtgagagcttcacagtgcagcggcgag;

DRB1*160102:
(SEQ ID NO: 2813)
cgtttcctgtggcagcctaagagGgagtgtcatttcttcaatgggacggagcgggtgcggttcctggacagatact tctataaccaggaggagtccgtgcgcttcgacagcgacgtgggggagtaccgggcggtgacggagctggggcggcc -continued tgacgctgagtactggaacagccagaaggacTtcctggaagaCaggcgggccgcggtggacacctactgcagacac aactacggggttggtgagagcttcaca;

DRB1*160201;

(SEQ ID NO: 2814)
atggtgtgtctgaagctccctggaggctcctgcatgacagcgctgacagtgacactgatggtgctgagctccccac tggctttggctggggacacccgaccacgtttcctgtggcagcctaagagGgagtgtcatttcttcaatgggacgga gcgggtgcggttcctggacagatacttctataaccaggaggagtccgtgcgcttcgacagcgacgtgggggagtac cgggcggtgacggagctggggcggcctgacgctgagtactggaacagccagaaggacctcctggaagacaggcgCg ccgcggtggacacctactgcagacacaactacggggttggtgagagcttcacagtgcagcggcgag;

DRB1*160202:

(SEQ ID NO: 2815)
tttcctgtggcagcctaagagGgagtgtcatttcttcaatgggacggagcgggtgcggttcctggacagatacttc tataaccaggaggagtccgtgcgcttcgacagcgacgtgggggagtaccgggcggtgacggagctggggcggcctg acgctgagtactggaacagccagaaggacctcctggaagaCaggcgggccgcggtggacacctactgcagacacaa ctacggggttggtg;

DRB1*1603:

(SEQ ID NO: 2816)
atggtgtgtctgaagctccctggaggctcctgcatgacagcgctgacagtgacactgatggtgctgagctccccac tggctttggctggggacacccgaccacgtttcctgtggcagcctaagagggagtgtcatttcttcaatgggacgga gcgggtgcggttcctggacagatacttctataaccaggaggagtccgtgcgcttcgacagcgacgtgggggagtac cgggcggtgacggagctggggcggcctgacgctgagtactggaacagccagaaggacttcctggaagacagggCcg ccgcggtggacacctactgcagacacaactacggggttggtgagagcttcacagtgcagcggcgag;

DRB1*1604:

(SEQ ID NO: 2817)
tggcagcctaagagggagtgtcatttcttcaatgggacggagcgggtgcggttcctggacagatacttctataacc aGgaggagtccgtgcgcttcgacagcgacgtgggggagtaccgggcggtgacggagctggggcggcctgacgcTga gtactggaacagccagaaggacTtcctggaagaCaggcgggccCTggtggacacctactgcagacacaactacggg gttggtg;

DRB1*1605:

(SEQ ID NO: 2818)
ctgtggcagcctaagagGgagtgtcatttcttcaatgggacggagcgggtgcggttcctggacagatacttctata accaggaggagtccgtgcgcttcgacagcgacgtgggggagtaccgggcggtgacggagctggggcggcctgacgc tgagtactggaacagccagaaggacAtcctggaagacaggcgCgccgcggtggacacctactgcagacacaactac ggggttggtgag;

DRB1*1607:

(SEQ ID NO: 2819)
cacgtttcctgtggcagcctaagagggagtgtcatttcttcaatgggacggagcgggtgcggttccCggacagata cttctataaccaggaggagtccgtgcgcttcgacagcgacgtgggggagtaccgggcggtgacggagctggggcgg cctgacgctgagtactggaacagccagaaggacatcctggaagacaggcgcgccgcggtggacacctactgcagac acaactacggggttggtgagagcttcacagtgca;

DRB1*1608:

(SEQ ID NO: 2820)
cacgtttcctgtggcagcctaagagGgagtgtcatttcttcaatgggacggagcgggtgcggttcctggacagata cttctataaccaggaggagaAcgtgcgcttcgacagcgacgtgggggagtaccgggcggtgacggagctggggcgg cctgacgctgagtactggaacagccagaaggacTtcctggaagacaggcgCgccgcggtggacacctactgcagac acaactacggggttggtgagagcttcacagtgcagcggcgag;

-continued

DRB3*010101:
(SEQ ID NO: 2821)
ggggacacccgaccacgtttcttggagctgcGtaagtctgagtgtcatttcttcaatgggacggagcgggtgcggt acctggaCagatacttccataaccaggaggagttcCtgcgcttcgacagcgacgtgggggagtaccgggcggtgac ggagctggggcggcctgtCgccgagtcctggaacagccagaaggacctcctggagcagaagcggggccGgtggac aaTtactgcagacacaactacggggttggtgagagcttcacagtgcagcggcgag;

DRB3*01010201:
(SEQ ID NO: 2822)
atggtgtgtctgaagctccctggaggctccagcttggcagcgttgacagtgacactgatggtgctgagctcccgac tggcttttCgctggggacacccgaccacgtttcttggagctgcgtaagtctgagtgtcatttcttcaatgggacgga gcgggtgcggtacctggacagatacttccataaccaggaggagttcctgcgcttcgacagcgacgtgggggagtac cgggcggtgacggagctggggcggcctgtcgccgagtcctggaacagccagaaggacctcctggagcagaagcggg gccGgtggacaattactgcagacacaactacggggttggtgagagcttcacagtgcagcggcgag;

DRB3*010103:
(SEQ ID NO: 2823)
ggggacacccgaccacgtttcttggagctgcGtaagtctgagtgtcatttcttcaatgggacggagcgggtgcggt acctggaCagatacttccataaccaggaggagttcCtgcgcttcgacagcgacgtgggggagtaccgggcggtgac ggagctggggcggcctgttgccgagtcctggaacagccagaaggacctcctggagcagaagcggggccGgtggac aaTtactgcagacacaactacggggttggtgagagc;

DRB3*010104:
(SEQ ID NO: 2824)
cacgtttcttggagctgcgtaagtctgagtgtcatttcttcaatgggacggagcgggtgcggtacctggacagata cttccataaccaggaggagttcctgcgcttcgacagcgacgtgggggagtaccgggcggtgacggagctggggcgg cctgtcgccgagtcctggaacagccagaaggacctcctggagcagaagcggggccgggtggacaaTtactgcagac acaactacggAgttggtg;

DRB3*0102:
(SEQ ID NO: 2825)
ggggacacccgaccacgtttcttggagctgTGtaagtctgagtgtcatttcttcaatgggacggagcgggtgcggt acctggaCagatacttccataaccaggaggagttcCtgcgcttcgacagcgacgtgggggagtaccgggcggtgac ggagctggggcggcctgtCgccgagtcctggaacagccagaaggacctcctggagcagaagcggggccGgtggac aaTtactgcagacacaactacggggttggtgagagc;

DRB3*0103:
(SEQ ID NO: 2826)
cacgtttcttggagctgcGtaagtctgagtgtcatttcttcaatgggacggagcgggtgcggtacctggaGagata cttccataaccaggaggagttcCtgcgcttcgacagcgacgtgggggagtaccgggcggtgacggagctggggcgg cctgtCgccgagtcctggaacagccagaaggacctcctggagcagaagcggggccGgtggacaaTtactgcagac acaactacggggttggtgagagc;

DRB3*0104:
(SEQ ID NO: 2827)
cacgtttctcggagctgcGtaagtctgagtgtcatttcttcaatgggacggagcgggtgcggtacctggaCagata cttccataaccaggaggagttcCtgcgcttcgacagcgacgtgggggagtaccgggcggtgacggagctggggcgg cctgtCgccgagtcctggaacagccagaaggacctcctggagcagaagcggggccGgtggacaaTtactgcagac acaactacggggttggtgagagcttcaca;

DRB3*0105:
(SEQ ID NO: 2828)
cacgtttcttggagctgcgtaagtctgagtgtcatttcttcaatgggacggagcgggtgcggtacctgAacagata cttccataaccaggaggagttcctgcgcttcgacagcgacgtgggggagtaccgggcggtgacggagctggggcgg cctgtcgccgagtcctggaacagccagaaggacctcctggagcagaagcggggccgggtggacaaTtactgcagac acaactacggggttggtgagagcttcacagtgcagcggcg;

DRB3*0106:
(SEQ ID NO: 2829)
cacgtttcttggagctgcGtaagtctgagtgtcatttcttcaatgggacggagcgggtgcggtacctggaCagata cttccataaccaggaggagtTcgtgcgcttcgacagcgacgtgggggagtaccgggcggtgacggagctggggcgg cctgtCgccgagtcctggaacagccagaaggacctcctggagcagaagcggggccGgtggacaaTtactgcagac acaactacggggttggtg;

DRB3*0107:
(SEQ ID NO: 2830)
cacgtttcttggagctgcGtaagtctgagtgtcatttcttcaatgggacggagcgggtgcggtacctggacagata cttccataaccaggaggagtacgcgcgcttcgacagcgacgtgggggagtaccgggcggtgagggagctggggcgg cctgatgccgagtactggaacagccagaaggacctcctggagcagaAgcggggccAggtggacaaTtactgcagac acaactacggggttggtg;

DRB3*0108:
(SEQ ID NO: 2831)
cacgtttcttggagctgcGtaagtctgagtgtcatttcttcaatgggacggagcgggtgcggtacctggacagata cttccataaccaggaggagAAcgtgcgcttcgacagcgacgtgggggagtaccgggcggtgacggagctggggcgg cctgtCgccgagtcctggaacagccagaaggacctcctggagcagaagcggggccGgtggacaaTtactgcagac acaactacggggttggtgagagcttcacagtgcagcgg;

DRB3*0109:
(SEQ ID NO: 2832)
cacgtttcttggagctgcGtaagtctgagtgtcatttcttcaatgggacggagcgggtgcggttcctggagagaca cttccataaccaggaggagtacgCgcgcttcgacagcgacgtgggggagtaccgggcggtgacggagctggggcgg cctgtCgccgagtcctggaacagccagaaggacctcctggagcagaagcggggccGgtggacaaTtactgcagac acaactacggggttggtgagagcttcacagtgcagcgg;

DRB3*0110:
(SEQ ID NO: 2833)
cacgtttcttggagctgcgtaagtctgagtgtcatttcttcaatgggacggagcgggtgcggtacctggacagata cttccataaccaggaggagttcctgAgcttcgacagcgacgtgggggagtaccgggcggtgacggagctggggcgg cctgtcgccgagtcctggaacagccagaaggacctcctggagcagaagcgggccgggtggacaattactgcagac acaactacggggttggtg;

DRB3*0201:
(SEQ ID NO: 2834)
atggtgtgtctgaagctccctggaggctccagcttggcagcgttgacagtgacactgatggtgctgagctcccgac tggcttttCgctggggacacccgaccacgtttcttggagctgcttaagtctgagtgtcatttcttcaatgggacgga gcgggtgcggttcctggagagacacttccataaccaggaggagtacgcgcgcttcgacagcgacgtgggggagtac cgggcggtgagggagctggggcggcctgatgccgagtactggaacagccagaaggacctcctggagcagaagcggg gccaggtggacaattactgcagacacaactacggggttgtGgagagcttcacagtgcagcggcgag;

DRB3*020201:
(SEQ ID NO: 2835)
ggggacacccgaccacgtttcttgGagctgcttaagtctgagtgtcatttcttcaatgggacggagcgggtgcggt tcctggagagaCacttccataaccaggaggagtacgCgcgcttcgacagcgacgtgggggagtaccgggcggtgaG ggagctggggcggcctgatgccgagtactggaacagccagaaggacctcctggagcagaagcggggccaggtggac aaTtactgcagacacaactacggggttggtgagagcttcacagtgcagcggcgag;

DRB3*020202:
(SEQ ID NO: 2836)
cacgtttcttggagctgcttaagtctgagtgtcatttcttcaatgggacggagcgggtgcggttcctggagagaCa cttccataaccaggaggagtacgCgcgcttcgacagcgacgtgggggagtaccgggcggtgaGggagctggggcgg cctgatgccgagtactggaacagccagaaggacctcctggagcagaagcggggccAggtggacaActactgcagac acaactacggggttggtg;

DRB3*020203:
(SEQ ID NO: 2837)
cacgtttcttggagctgcttaagtctgagtgtcatttcttcaatgggacggagcgggtgcggttcctggagagaca cttccataaccaggaggagtacgcgcgcttcgacagcgacgtgggggagtaccgggcggtgagggagctggggcgg cctgatgccgagtactggaacagccagaaggacctcctggagcagaagcggggccaggtggacaattactgcagGc acaactacggggttggtgagagcttcacagtgcagcggcgag;

DRB3*020204:
(SEQ ID NO: 2838)
cacgtttcttggagctgcttaagtctgagtgtcatttcttcaatgggacggagcgggtgcggttcctggagagaca cttccataaccaggaggagtacgcgcgcttcgacagcgacgtgggggagtaccgggcggtgaGggagctggggcgg cctgatgcGgagtactggaacagccagaaggacctcctggagcagaagcggggccaggtggacaaTtactgcagac acaactacggggttggtgagagcttcacagtgcagcggcgag;

DRB3*0203:
(SEQ ID NO: 2839)
ttggagctgcttaagtctgagtgtcatttcttcaatgggacggagcgggtgcggttcctggagagaCacttccata accaGgaggagtccgtgcgcttcgacagcgacgtgggggagtaccgggcggtgaGggagctggggcggcctgatgc cgagtactggaacagccagaaggacctcctggagcagaagcggggccaggtggacaaTtactgcagacacaactac ggggttggtgaga;

DRB3*0204:
(SEQ ID NO: 2840)
cacgtttcttggagctgcttaagtctgagtgtcatttcttcaatgggacggagcgggtgcggttcctggagagaca cttccataaccaggaggagtacgcgcgcttcgacagcgacgtgggggagtaccgggcggtgaGggagctggggcgg cctgatgccgagtactggaacagccagaaggacctcctggagcagaagcggggccGgtggacaActactgcagac acaactacggggttgtGgagagcttcacagtgcagcggcgag;

DRB3*0205:
(SEQ ID NO: 2841)
cgtttcttggagctgcttaagtctgagtgtcatttcttcaatgggacggagcgggtgcggttcctggaGagatact tccataaccaggaggagtacgCgcgcttcgacagcgacgtgggggagtaccgggcggtgaGggagctggggcggcc tgatgccgagtactggaacagccagaaggacctcctggagcagaagcggggccaggtggacaaTtactgcagacac aactacggggttggtgagagcttcacagtgcag;

DRB3*0206:
(SEQ ID NO: 2842)
cacgtttcttggagctgcttaagtctgagtgtcatttcttcaatgggacggagcgggtgcggttcctggagagaca cttccataaccaggaggagAacgCgcgcttcgacagcgacgtgggggagtaccgggcggtgaGggagctggggcgg cctgatgccgagtactggaacagccagaaggacctcctggagcagaagcggggccaggtggacaaTtactgcagac acaactacggggttggtg;

DRB3*0207:
(SEQ ID NO: 2843)
ttggagctgcttaagtctgagtgtcatttcttcaatgggacggagcgggtgcggttcctggagagacacttccata accaggaggagtacgcgcgcttcgacagcgacgtgggggagtaccgggcggtgaGggagctggggcggcctgTCgc cgagtactggaacagccagaaggacctcctggagcagaagcggggccaggtggacaaTtactgcagacacaactac ggggttggtgagag;

DRB3*0208:
(SEQ ID NO: 2844)
cacgtttcttggagctgcttaagtctgagtgtcatttcttcaatgggacggagcgggtgcggttcctggagagaca
cttccataaccaggaggagtacgcgcgcttcgacagcgacgtgggggagtaccgggcggtgaGgagctggggcgg
cctaGCgccgagtactggaacagccagaaggacctcctggagcagaagcggggccaggtggacaaTtactgcagac
acaactacggggttggtg;

DRB3*0209:
(SEQ ID NO: 2845)
cacgtttcttggagctgcttaagtctgagtgtcatttcttcaatgggacggagcgggtgcggttcctggagagaca
cttccataaccaggaggagtacgCgcgcttcgacagcgacgtgggggagtaccgggcggtgacggagctggggcgg
cctgtcgccgagtCctggaacagccagaaggacctcctggagcagaagcggggccAggtggacaaTtactgcagac
acaactacggggttggtgagagcttcaca;

DRB3*0210:
(SEQ ID NO: 2846)
ggggacacccgaccacgtttcttgGagctgcttaagtctgagtgtcatttcttcaatgggacggagcgggtgcggt
tcctggagagaCacttccataaccaggaggagtacgCgcgcttcgacagcgacgtgggggagtaccgggcggtgac
ggagctggggcggcctgatgccgagtactggaacagccagaaggacctcctggagcagaagcggggccAggtggac
aaTtactgcagacacaactacggggttggtgagagcttcacagtgcagcggcgag;

DRB3*0211:
(SEQ ID NO: 2847)
ggggacacccgaccacgtttcttggagctgcttaagtctgagtgtcatttcttcaatgggacggagcgggtgcggt
tcctggagagacacttccataaccaggaggagtacgcgcgcttcgacagcgacgtgggggagtaccgggcggtgaG
ggagctggggcggcctgatgccgagtactggaacagccagaaggacAtcctggagcagaagcggggccaggtggac
aaTtactgcagacacaactacggggttggtgagagcttcacagtgcagcggcgag;

DRB3*0212:
(SEQ ID NO: 2848)
cacgtttcttgcagctgcttaagtctgagtgtcatttcttcaatgggacggagcgggtgcggttcctggagagaCa
cttccataaccaggaggagtacgCgcgcttcgacagcgacgtgggggagtaccgggcggtgaGgagctggggcgg
cctgatgccgagtactggaacagccagaaggacctcctggagcagaagcggggccaggtggacaaTtactgcagac
acaactacggggttggtgagagcttcacagtgcagcggcgag;

DRB3*0213:
(SEQ ID NO: 2849)
cacgtttcttggagctgcttaagtctgagtgtcatttcttcaatgggacggagcgggtgcggCtcctggagagaca
cttccataaccaggaggagtacgcgcgcttcgacagcgacgtgggggagtaccgggcggtgagggagctggggcgg
cctgatgccgagtactggaacagccagaaggacctcctggagcagaagcggggccaggtggacaattactgcagac
acaactacggggttggtgagagcttcacagtgcagcggcgag;

DRB3*0214:
(SEQ ID NO: 2850)
cacgtttcttggagctgcttaagtctgagtgtcatttcttcaatgggacggagcgggtgcggttcctggagagaca
cttccataaccaggaggagtacgcgcgcttcgacagcgacgtgggggagtaccgggcggtgagggagctggggcgg
cctgatgccgagtactggaacagccagaaggacctcctggagcagaagcggggccaggtggacaattactgcagac
acaactacggggttgCtgagagcttcacagtgcagcggcgag;

DRB3*0215:
(SEQ ID NO: 2851)
cacgtttcttggagctgcttaagtctgagtgtcatttcttcaatgggacggagcgggtgcggttcctggagagaCa
cttccataaccaggaggagtacgCgcgcttcgacagcgacgtgggggagtaccgggcggtgaGgagctggggcgg
cctgatgccgagtactggaacagccagaaggacctcctggagcagaagcggggccAggtggacacctactgcagac
acaactacggggttggtgagagcttcacagtgcagcggcgag;

DRB3*0216:
(SEQ ID NO: 2852)
cacgtttcttggagctgcttaagtctgagtgtcatttcttcaatgggacggagcgggtgcggttcctggagagaca
cttccataaccaggaggagtacgcgcgcttcgacagcgacgtgggggagtaccgggcggtgaGggagctggggcgg
cctgctgcggagCactggaacagccagaaggacctcctggagcagaagcggggccaggtggacaaTtactgcagac
acaactacggggttggtgagagcttcacagtgcagcggcgag;

DRB3*0217:
(SEQ ID NO: 2853)
cacgtttcttggagctgcttaagtctgagtgtcatttcttcaatgggacggagcgggtgcggttcctggagagaca
cttccataaccaggaggagtacgcgcgcttcgacagcgacgtgggggagtaccgggcggtgaGggagctggggcgg
cctgatgccgagtactggaacagccagaaggacTtcctggagcagaagcggggccaggtggacaaTtactgcagac
acaactacggggttggtgagagcttcacagtgcagcggcgag;

DRB3*030101:
(SEQ ID NO: 2854)
ggggacacccgaccacgtttcttggagctgcttaagtctgagtgtcatttcttcaatgggacggagcgggtgcggt
tcctggagagatacttccataaccaggaggagttcgtgcgcttcgacagcgacgtgggggagtaccgggcggtgac
ggagctggggcggcctgtcgccgagtCctggaacagccagaaggacctcctggagcagaagcggggccaggtggac
aaTtactgcagacacaactacggggttgtGgagagcttcacagtgcagcggcgag;

DRB3*030102:
(SEQ ID NO: 2855)
cacgtttcttggagctgcttaagtctgagtgtcatttcttcaatgggacggagcgggtgcggttcctggagagata
cttccataaccaggaggagttcgtgcgcttcgacagcgacgtgggggagtaccgggcggtgacggagctggggcgg
cctgtcgccgagtcctggaacagccagaaggacctcctggagcagaagcggggccaggtggacaattactgcagac
acaactacggCgttgtggagagcttcacagtgcagcggcgag;

DRB3*0302:
(SEQ ID NO: 2856)
cacgtttcttggagctgcttaagtctgagtgtcatttcttcaatgggacggagcgggtgcggttcctggagagaCa
cttccataaccaggaggagttcgtgcgcttcgacagcgacgtgggggagtaccgggcggtgacggagctggggcgg
cctgtcgccgagtCctggaacagccagaaggacctcctggagcagaagcggggccaggtggacaaTtactgcagac
acaactacggggttgtGg;

DRB3*0303:
(SEQ ID NO: 2857)
tttcttggagctgcttaagtctgagtgtcatttcttcaatgggacggagcgggtgcggttcctggaGagatacttc
cataaccaggaggagtTcgtgcgcttcgacagcgacgtgggggagtaccgggcggtgacggagctggggcggcctg
tCgccgagtCctggaacagccagaaggacctcctggagcagaagcggggccGgtggacaaTtactgcagacacaa
ctacggggttggtgagagcttcaca;

DRB4*010101:
(SEQ ID NO: 2858)
atggtgtgtctgaagctccctggaggctcctgtatggcagcgctgacagtgacattgaCggtgctgagctccccac
tggctttggctggggacacccaaccacgtttcttggagcaggctaagtgtgagtgtcatttcctcaatgggacgga
gcgagtgtggaacctgatcagatacatctataaccaagaggagtacgcgcgctacaacagtgacctgggggagtac
caggcggtgacggagctggggcggcctgacgctgagtactggaacagccagaaggacctcctggagcggaggcggg
ccgaggtggacacctactgcagatacaactacggggttgtggagagcttcacagtgcagcggcgag;

DRB4*0102:
(SEQ ID NO: 2959)
gagcgagtgtggaacctgatcagatacatctataaccaagaggagtacgcgcgctacaacagtgacctgggggagt
accaggcggtgacggagctggggcggcctgacgctgagtactggaacagccagaaggacctcctggagcggaggcg
ggccgaggtggGcacctactgcagatacaactacggggttgtggagagcttcacagtgcagcggcgag;

-continued

DRB4*010302:
(SEQ ID NO: 2860)
ggggacacccaaccacgtttcttggagcaggctaagtgtgagtgtcatttcCtcaatgggacggagcgagtgtgga
aCctgatcagatacatctataaccaagaggagtacgcgcgctacaacagtgacctgggggagtaccaggcggtgac
ggagctgggcggcctgacgctgagtactggaacagccagaaggacctcctggagcggaggcgggccgaggtggac
acctactgcagaTacaactacggggttgtggagagcttcacagtgcagcggcgag;

DRB4*010303:
(SEQ ID NO: 2861)
atggtgtgtctgaagctccctggaggctcctgtatggcagcgctgacagtgacattgaCggtgctgagctccccac
tggctttggctggggacacccaaccacgtttcttggagcaggctaagtgtgagtgtcatttcctcaatgggacgga
gcgagtgtggaacctgatcagatacatctataaccaagaggagtacgcgcgctacaacagtgacctgggggagtac
caggcggtgacggagctggggcggcctgacgctgagtactggaacagccagaaggacctcctggagcggaggcggg
ccgaggtggacacctaTtgcagatacaactacggggttgtggagagcttcacagtgcagcggcgag;

DRB4*010304:
(SEQ ID NO: 2862)
cacgtttcttggagcaggctaagtgtgagtgtcatttcctcaatgggacggagcgagtgtggaacctgatcagata
catctataaccaagaggagtacgcgcgctacaacagtgaTctgggggagtaccaggcggtgacggagctggggcgg
cctgacgctgagtactggaacagccagaaggacctcctggagcggaggcgggccgaggtggacacctactgcagat
acaactacggggttgtggagagcttcacagtgcagcggcgag;

DRB4*0104:
(SEQ ID NO: 2863)
cacgtttcttggagcaggctaagtgtgagtgtcatttcctcaatgggacggagcgagtgtggaacctgatcagata
catctataaccaagaggagtacgcgcgctacaacagtgacctgggggagtaccaggcggtgacggagctggggcgg
cctgacgctgagtactggaacagccagaaggacctcctggagcggaggcgggccgaggtggacaActactgcagaT
acaactacggggttgtggagagcttcacagtgcagcggcgag;

DRB4*0105:
(SEQ ID NO: 2864)
ttggagcaggctaagtgtgagtgtcatttcCtcaatgggacggagcgagtgtggAacctgatcagatacatctata
accaagaggagtacgcgcgctacaacagtgacctgggggagtaccaggcggtgacggagctggggcggcctgacgc
tgagtactggaacagccagaaggacctcctggagcggaggcgggccgaggtggacacctactgcagacacaactac
ggggttgtggagag;

DRB4*0106:
(SEQ ID NO: 2865)
cacgtttcttggagcaggctaagtgtgagtgtcatttcCtcaatgggacggagcgagtgtggaaCctgatcagata
catctataaccaagaggagtacgcgcgctacaacagtgacctgggggagtaccaggcggtgacggagctggggcgg
cctgacgctgagtactggaacagccagaaggacctcctggagcggaggcgggccgaggtggacacctactgcagaT
acaactacggggttgtggagagcttcacagtgcagcggcgag;

DRB4*0201N:
(SEQ ID NO: 2866)
ggtgctgagctccccactggctttggctggggacacccAaccacgtttcttggagcaggctaagtgtgagtgtcat
ttcctcaatgggacggagcctgatcagatacatctataaccaagaggagtacgcgcgctacaacagtgacctgggg
gagtaccaggcggtgacggagctggggcggcctgacgctgagtactggaacagccagaaggacctcctggagcgga
ggcgggccgaggtggacacctactgcagatacaactacggggttgtGgagagcttcacagtgcagcggcgag;

DRB5*010101:
(SEQ ID NO: 2867)
atggtgtgtctgaagctccctggaggttcctacatggcaaAgctgacagtgacactgatggtgctgagctccccac
tggctttggctggggacacccgaccacgtttcttgcagcaggataagtatgagtgtcatttcttcaacgggacgga
gcgggtgcggttcctgcacagagacatctataaccaagaggaggacttgcgcttcgacagcgacgtggggagtac cgggcggtgacggagctggggcggcctgacgctgagtactggaacagccagaaggacttcctggaagacaggcgcg ccgcggtggacacctactgcagacacaactacggggttggtgagagcttcacagtgcagcggcgag;

DRB5*010102:
(SEQ ID NO: 2868)
cacgtttcttgcagcaggataagtatgagtgtcatttcttcaacgggacggagcgggtgcggttcctgcacagaga catctataaccaagaggaggacTtgcgcttcgacagcgacgtgggggagtaccgggcggtgacggagctggggcgg cctgacgcTgagtactggaacagccagaaggacTtcctggaaGaCaggcgggccgcggtggacacctactgcagac acaactacggggttggtgagagcttcaca;

DRB5*0102:
(SEQ ID NO: 2869)
ggggacacccgaccacgtttcttgCagcaggataagtatgagtgtcatttcttcaacgggacggagcgggtgcggt tcctgcacagaggcatctataaccaagaggagAacgtgcgcttcgacagcgacgtgggggagtaccgggcggtgac ggagctggggcggcctgacgctgagtactggaacagccagaaggacTtcctggaaGacaggcgCgccgcggtggac acctactgcagacacaactacggggttggtgagagcttcacagtgcagcggcgag;

DRB5*0103;
(SEQ ID NO: 2870)
ttgcagcaggataagtatgagtgtcatttcttcaacgggacggagcgggtgcggttcctgcacagaGgcatctata accaagaggagaacgtgcgcttcgacagcgacgtgggggagtaccgggcggtgacggagctggggcggcctgacgc tgagtactggaacagccagaaggacttcctggaagacaCgcgCgccgcggtggacacctactgcagacacaactac ggggttggtgagagcttcacag;

DRB5*0104:
(SEQ ID NO: 2871)
ggggacacccgaccacgtttcttgcagcaggataagtatgagtgtcatttcttcaacgggacggagcgggtgcggt tcctgcacagagacatctataaccaagaggaggacTtgcgcttcgacagcgacgtgggggagtaccgggcggtgac ggagctggggcggcctgacgctgagtactggaacagccagaaggacttcctggaagacaggcggggcccTggtggac acctactgcagacacaactacggggttggtgagagcttcacagtgcagcggcgag;

DRB5*0105:
(SEQ ID NO: 2872)
ccacgtttcttgcagcaggataagtatgagtgtcatttcttcaacgggacggagcgggtgcggttcctgcacagag acatctataaccaagaggagGacgtgcgcttcgacagcgacgtgggggagtaccgggcggtgacggagctggggcg gcctgacgctgagtactggaacagccagaaggacTtcctggaaGacaggcgCgccgcggtggacacctactgcaga cacaactacggggttggtgagagcttcacagtgcagcgg;

DRB5*0106:
(SEQ ID NO: 2873)
cacgtttcttgcagcaggataagtatgagtgtcatttcttcaacgggacggagcgggtgcggttcctgcacagaga catctataaccaagaggaggacTtgcgcttcgacagcgacgtgggggagtaccgggcggtgacggagctggggcgg cctgacgctgagtactggaacagccagaaggacatcctggagcaggcgcgggccgcggtggacacctactgcagac acaactacggggctgtGgagagcttcacagtgcagcggcga;

DRB5*0107:
(SEQ ID NO: 2874)
cacgtttcttgcagcaggataagtatgagtgtcatttcttcaacgggacggagcgggtgcggttcctgcacagaga catctataaccaagaggaggacTtgcgcttcgacagcgacgtgggggagtaccgggcggtgacggagctggggcgg cctgacgctgagtactggaacagccagaaggacAtcctggaaGacaggcgCgccgcggtggacacctactgcagac acaactacggggttggtg;

DRB5*0109:
(SEQ ID NO: 2875)
cacgtttcttgcagcaggataagtatgagtgtcatttcttcaacgggacggagcgggtgcggttcctgcacagaga catctataaccaagaggaggacttgcgcttcgacagcgacgtgggggagtaccgggcggtgacggagctggggcgg -continued cctgacgctgagtactggaacagccagaaggacttcctggaaAacaggcgcgccgcggtggacacctactgcagac acaactacggggttggtg;

DRB5*0110N:
(SEQ ID NO: 2876)
cacgtttcttgcagcaggataagtatgagtgtcatttcttcaacgggacggagcgggtgcggttcctgcacagaGg catctataaccaagaggagAacgtgcgcttcgacagcgacgtgggggagtaccgggcggtgacggagctggggcgg cctgacgctgagtactggaacagccagaaggacTtcctggaaGacaggcgCgccgcggtggacacctactgca..c acaactacggggttggtgagagcttcacagtgcagcggcgag;

DRB5*0111:
(SEQ ID NO: 2877)
cacgtttcttgcagcaggataagtatgagtgtcatttcttcaacgggacggagcgggtgcggttcctgcacagaga catctataaccaagaggaggacTtgcgcttcgacagcgacgtgggggagtaccgggcggtgacggagctggggcgg cctgacgctgagtactggaacagccagaaggacatcctggagcaggCgcgggccgcggtggacacctactgcagac acaactacggggttggtgagagcttcacagtgcagcggcgag;

DRB5*0112:
(SEQ ID NO: 2878)
cacgtttcttgcagcaggataagtatgagtgtcatttcttcaacgggacggagcgggtgcggttcctgcacagaga catctataaccaagaggaggacTtgcgcttcgacagcgacgtgggggagtaccgggcggtgacggagctggggcgg cctgacgccgagtCctggaacagccagaaggacttcctggagcGgaggcgggccgaggtggacaccgtGtgcagac acaactacggggttggtgagagcttcacagtgcagcggcgag;

DRB5*0202:
(SEQ ID NO: 2879)
atggtgtgtctgaagctccctggaggttcctAcatggcagtgctgacagtgacactgatggtgctgagctccccac tggctttggctggggacacccgaccatgtttcttgcagcaggataagtatgagtgtcatttcttcaacgggacgga gcgggtgcggttcctgcacagaggcatctataaccaagaggagaacgtgcgcttcgacagcgacgtgggggagtac cgggcggtgacggagctggggcggcctgacgctgagtactggaacagccagaaggacatcctggagcaggcgcggg ccgcggtggacacctactgcagacacaactacggggctgtGgagagcttcacagtgcagcggcgag;

DRB5*0203:
(SEQ ID NO: 2880)
tttcttgcagcaggataagtatgagtgtcatttcttcaacgggacggagcgggtgcggttcctgcacagaGgcatc tataaccaagaggagAacgtgcgcttcgacagcgacgtgggggagtaccgggcggtgacggagctggggcggcctg acgctgagtactggaacagccagaaggacAtcctggagcagGCgcgggccgcggtggacacctactgcagacacaa ctacggggttggtgagagcttcacagtgcagcgg;

DRB5*0204:
(SEQ ID NO: 2881)
catgtttcttgcagcaggataagtatgagtgtcatttcttcaacgggacggagcgggtgcggttcctgcacagaGg catctataaccaagaggagaacgtgcgcttcgacagcgacgtgggggagtaccgggcggtgacggagctggggcgg cctgacgctgagtactggaacagccagaaggacTtcctggagcaggCgcgggccgcggtggacacctactgcagac acaactacggggctgtGgagagcttcaca;

DRB5*0205:
(SEQ ID NO: 2882)
catgtttcttgcagcaggataagtatgagtgtcatttcttcaacgggacggagcgggtgcggttcctgcacagaGg catctataaccaagaggagAacgtgcgcttcgacagcgacgtgggggagtaccgggcggtgacggagctggggcgg cctgacgctgagtactggaacagccagaaggacctcctggagcagaggcgggccgcggtggacacctactgcagac acaactacggggctgtGgagagcttcacagtgcagcggcgag In the following, Probe List DR1 and 2 are shown in Tables 21-1 to 21-8 and Tables 22-1 to 22-7 respectively. Allele-Probe Lists 1 and 2 are shown in Tables 23-1 to 23-13 and Tables 24-1 to 24-13 respectively.

TABLE 21-1

| Probe No. | Base Sequence | |
|---|---|---|
| 0 | g gtg cgg ttg Ctg gaA | (SEQ ID No: 2883) |
| 1 | g Cgg ttg ctg gaa aga T | (SEQ ID No: 2884) |
| 2 | c tat aac caa gag gag tC | (SEQ ID No: 2885) |
| 3 | ctg ggg cgg cct gaT | (SEQ ID No: 2886) |
| 4 | ggg cgg cct gat gcC | (SEQ ID No: 2887) |
| 5 | cac aac tac ggg gtt gG | (SEQ ID No: 2888) |
| 6 | c atc tat aac caa gag gaA | (SEQ ID No: 2889) |
| 7 | c gcg gtg gac acc taT | (SEQ ID No: 2890) |
| 8 | ga cac aac tac ggg gC | (SEQ ID No: 2891) |
| 9 | ag agg cgg gcc gcC | (SEQ ID No: 2892) |
| 10 | g aac agc cag aag gac A | (SEQ ID No: 2893) |
| 11 | g gac atc ctg gaa gac G | (SEQ ID No: 2894) |
| 12 | gac atc ctg gaa gac gA | (SEQ ID No: 2895) |
| 13 | g gcc gcg gtg gac aaT | (SEQ ID No: 2896) |
| 14 | ac aac tac ggg gtt gtG | (SEQ ID No: 2897) |
| 15 | c ttc gac agc gac gtg A | (SEQ ID No: 2898) |
| 16 | c ctc ctg gag cag gC | (SEQ ID No: 2899) |
| 17 | ca cgt ttc ttg tgg G | (SEQ ID No: 2900) |
| 18 | tc tat aac caa gag gag tA | (SEQ ID No: 2901) |
| 19 | gac ctc ctg gag cag G | (SEQ ID No: 2902) |
| 20 | gac ctc ctg gag cag aA | (SEQ ID No: 2903) |
| 21 | g gag cgg gtg cgg tA | (SEQ ID No: 2904) |
| 22 | c ctg gac aga tac ttc C | (SEQ ID No: 2905) |
| 23 | c cat aac cag gag gag A | (SEQ ID No: 2906) |
| 24 | c cat aac cag gag gag aA | (SEQ ID No: 2907) |
| 25 | gc gac gtg ggg gag tT | (SEQ ID No: 2908) |
| 26 | G cag aag cgg ggc cG | (SEQ ID No: 2909) |
| 27 | G ggc cgg gtg gac aA | (SEQ ID No: 2910) |
| 28 | g ggc cgg gtg gac aaT | (SEQ ID No: 2911) |
| 29 | ca cgt ttc ttg gA | (SEQ ID No: 2912) |
| 30 | g gtg cgg ttc ctg gaG | (SEQ ID No: 2913) |

TABLE 21-2

| Probe No. | Base Sequence | |
|---|---|---|
| 31 | c ctg gag aga tac ttc C | (SEQ ID No: 2914) |
| 32 | c aga tac ttc cat aac caG | (SEQ ID No: 2915) |
| 33 | tt ggt gag agc ttc acG | (SEQ ID No: 2916) |
| 34 | g gtg cgg tac ctg gaC | (SEQ ID No: 2917) |
| 35 | g ggg cgg cct gat gA | (SEQ ID No: 2918) |
| 36 | ggg cgg cct gat gaG | (SEQ ID No: 2919) |
| 37 | c aga tac ttc cat aac cG | (SEQ ID No: 2920) |
| 38 | ctg ggg cgg cct gC | (SEQ ID No: 2921) |
| 39 | ag cag aag cgg ggc C | (SEQ ID No: 2922) |
| 40 | g cag aag cgg ggc cA | (SEQ ID No: 2923) |
| 41 | gg ggc cag gtg gac aA | (SEQ ID No: 2924) |
| 42 | ctg ggg cgg cct agC | (SEQ ID No: 2925) |
| 43 | gg cct gat gcc gag tC | (SEQ ID No: 2926) |
| 44 | gac gtg ggg gag ttc T | (SEQ ID No: 2927) |
| 45 | gt ttc ttg gag tac tct aC | (SEQ ID No: 2928) |
| 46 | g gtg cgg ttc ctg gaC | (SEQ ID No: 2929) |
| 47 | g tac cgg gcg gtg aG | (SEQ ID No: 2930) |
| 48 | g ggc cag gtg gac aaT | (SEQ ID No: 2931) |
| 49 | ttc gac agc gac gtg C | (SEQ ID No: 2932) |
| 50 | c cat aac cag gag gag tT | (SEQ ID No: 2933) |
| 51 | c ctg gac aga tac ttc G | (SEQ ID No: 2934) |
| 52 | c cat aac cag gag gag tA | (SEQ ID No: 2935) |
| 53 | atg gtg tgt ctg aag T | (SEQ ID No: 2936) |
| 54 | ga tac ttc tat cac caa gaA | (SEQ ID No: 2937) |
| 55 | tc ttg gag cag gtt aaa C | (SEQ ID No: 2938) |
| 56 | c tat cac caa gag gag tA | (SEQ ID No: 2939) |
| 57 | g cag agg cgg gcc gA | (SEQ ID No: 2940) |
| 58 | ggg cgg cct gac gcT | (SEQ ID No: 2941) |
| 59 | c ttg gag cag gtt aaa cA | (SEQ ID No: 2942) |
| 60 | ctg gac aga tac ttc tat C | (SEQ ID No: 2943) |

TABLE 21-3

| Probe No. | Base Sequence | |
|---|---|---|
| 61 | g ctg ggg cgg cct aG | (SEQ ID No: 2944) |
| 62 | a gag gag tac gtg cgG | (SEQ ID No: 2945) |
| 63 | gc ttc aca gtg cag cgA | (SEQ ID No: 2946) |
| 64 | c ctc ctg gag cag agA | (SEQ ID No: 2947) |
| 65 | t ttc ttg gag cag gtt aaA | (SEQ ID No: 2948) |
| 66 | a gac agg cgg gcc cT | (SEQ ID No: 2949) |
| 67 | g aac agc cag aag gac T | (SEQ ID No: 2950) |
| 68 | ag gac ttc ctg gaa gaC | (SEQ ID No: 2951) |

TABLE 21-3-continued

| Probe No. | Base Sequence | |
|---|---|---|
| 69 | gg cgg cct gat gcc C | (SEQ ID No: 2952) |
| 70 | c ggg gtt gtg gag agA | (SEQ ID No: 2953) |
| 71 | g gac ctc ctg gag cG | (SEQ ID No: 2954) |
| 72 | ctg ggg cgg cct gat A | (SEQ ID No: 2955) |
| 73 | ag tac cgg gcg gtg aT | (SEQ ID No: 2956) |
| 74 | g ggg gag tac cgg gT | (SEQ ID No: 2957) |
| 75 | g cag agg cgg gcc C | (SEQ ID No: 2958) |
| 76 | g cag agg cgg gcc cT | (SEQ ID No: 2959) |
| 77 | tc ctg gag cag agg cA | (SEQ ID No: 2960) |
| 78 | caa gag gag tac gtg cA | (SEQ ID No: 2961) |
| 79 | c ttg gag cag gtt aaa cC | (SEQ ID No: 2962) |
| 80 | gac ctc ctg gaa gac G | (SEQ ID No: 2963) |
| 81 | gac ctc ctg gaa gac gA | (SEQ ID No: 2964) |
| 82 | gac atc ctg gag cag aA | (SEQ ID No: 2965) |
| 83 | agc gac gtg gaC | (SEQ ID No: 2966) |
| 84 | g ggg cgg cct gat gG | (SEQ ID No: 2967) |
| 85 | tc tat cac caa gag gag A | (SEQ ID No: 2968) |
| 86 | c tat cac caa gag gag aA | (SEQ ID No: 2969) |
| 87 | g gct ggg gac acc cA | (SEQ ID No: 2970) |
| 88 | g gac agg cgg ggc C | (SEQ ID No: 2971) |
| 89 | c cag gtg gac acc gtG | (SEQ ID No: 2972) |
| 90 | tc ctg tgg cag ggt aaA | (SEQ ID No: 2973) |

TABLE 21-4

| Probe No. | Base Sequence | |
|---|---|---|
| 91 | g gcg gtg acg gag ctA | (SEQ ID No: 2974) |
| 92 | g cct gtc gcc gag tC | (SEQ ID No: 2975) |
| 93 | gtg cag ttc ctg gaa agT | (SEQ ID No: 2976) |
| 94 | ag tcc tgg aac agc cG | (SEQ ID No: 2977) |
| 95 | gg cgg cct gct gcG | (SEQ ID No: 2978) |
| 96 | gtg acg gag cta ggg T | (SEQ ID No: 2979) |
| 97 | c tct acg ggt gag tgt T | (SEQ ID No: 2980) |
| 98 | cgg ttc ctg gac aga taT | (SEQ ID No: 2981) |
| 99 | gc tcc tgc atg gca gT | (SEQ ID No: 2982) |
| 100 | g tac cgg gcg gtg acA | (SEQ ID No: 2983) |
| 101 | cac aac tac ggg gtt gT | (SEQ ID No: 2984) |
| 102 | gtt gtt gag agc ttc acG | (SEQ ID No: 2985) |
| 103 | tt gtg gag agc ttc acG | (SEQ ID No: 2986) |

TABLE 21-4-continued

| Probe No. | Base Sequence | |
|---|---|---|
| 104 | g ctg ggg cgg cct gT | (SEQ ID No: 2987) |
| 105 | gg cct gct gcg gag C | (SEQ ID No: 2988) |
| 106 | gt ttc ttg gag tac tct aG | (SEQ ID No: 2989) |
| 107 | gg cct gat gcg gag C | (SEQ ID No: 2990) |
| 108 | tc tat aac caa gag gag G | (SEQ ID No: 2991) |
| 109 | ag gac atc ctg gaa gaC | (SEQ ID No: 2992) |
| 110 | g ctg ggg cgg cct aT | (SEQ ID No: 2993) |
| 111 | c ttg gag tac tct acg tC | (SEQ ID No: 2994) |
| 112 | gt ttc ttg gag tac tct aT | (SEQ ID No: 2995) |
| 113 | c aac tac ggg gct gtG | (SEQ ID No: 2996) |
| 114 | ct gtg gag agc ttc acG | (SEQ ID No: 2997) |
| 115 | g agc ttc aca gtg cag A | (SEQ ID No: 2998) |
| 116 | ctg gag cgg agg cgT A | (SEQ ID No: 2999) |
| 117 | g ttg ctg gaa aga cgc G | (SEQ ID No: 3000) |
| 118 | ctg gag cgg agg cgC | (SEQ ID No: 3001) |
| 119 | g aag gac ttc ctg gaa G | (SEQ ID No: 3002) |
| 120 | g ctg gaa gac agg cgC | (SEQ ID No: 3003) |

TABLE 21-5

| Probe No. | Base Sequence | |
|---|---|---|
| 121 | t gag tgt cat ttc ttc aaC | (SEQ ID No: 3004) |
| 122 | gac ttc ctg gaa gac gA | (SEQ ID No: 3005) |
| 123 | c ttg gag tac tct acg G | (SEQ ID No: 3006) |
| 124 | g gac ctc ctg gaa gaC | (SEQ ID No: 3007) |
| 125 | g gac ttc ctg gaa gac G | (SEQ ID No: 3008) |
| 126 | tc tat aac caa gag gag tT | (SEQ ID No: 3009) |
| 127 | c aga tac ttc tat aac caG | (SEQ ID No: 3010) |
| 128 | c tat aac cag gag gag tT | (SEQ ID No: 3011) |
| 129 | at aac caa gag gag gac T | (SEQ ID No: 3012) |
| 130 | cgg agg cgg gcc gA | (SEQ ID No: 3013) |
| 131 | cc gag gtg gac acc taT | (SEQ ID No: 3014) |
| 132 | aa gac agg cgg gcc C | (SEQ ID No: 3015) |
| 133 | ttg gag tac tct acg tC | (SEQ ID No: 3016) |
| 134 | gag tac tct acg tct gaG | (SEQ ID No: 3017) |
| 135 | cag aag gac ttc ctg gaA | (SEQ ID No: 3018) |
| 136 | g gcc gcg gtg gac aA | (SEQ ID No: 3019) |
| 137 | ttc tat aat caa gag gag A | (SEQ ID No: 3020) |

TABLE 21-5-continued

| Probe No. | Base Sequence | |
|---|---|---|
| 138 | tc tat aac caa gag gag aA | (SEQ ID No: 3021) |
| 139 | ca cgt ttc ttg gag cT | (SEQ ID No: 3022) |
| 140 | cgg cct gat gag gag C | (SEQ ID No: 3023) |
| 141 | a gac agg cgg gcc gT | (SEQ ID No: 3024) |
| 142 | g cgg cct gat gag gaC | (SEQ ID No: 3025) |
| 143 | g cgg cct gat gag gG | (SEQ ID No: 3026) |
| 144 | g ttc cgg gcg gtg aG | (SEQ ID No: 3027) |
| 145 | gc tcc tgc atg gca gtT | (SEQ ID No: 3028) |
| 146 | ttg gct ggg gac acc A | (SEQ ID No: 3029) |
| 147 | g gag cgg gtg cgg ttA | (SEQ ID No: 3030) |
| 148 | c cat aac cag gag gag C | (SEQ ID No: 3031) |
| 149 | cag aag gac atc ctg gG | (SEQ ID No: 3032) |
| 150 | gag cgg gtg cgg ttC | (SEQ ID No: 3033) |

TABLE 21-6

| Probe No. | Base Sequence | |
|---|---|---|
| 151 | g gaa gac gag cgg gcT | (SEQ ID No: 3034) |
| 152 | c ctg gaa gac gag cGc | (SEQ ID No: 3035) |
| 153 | g gac atc ctg gaa gac aA | (SEQ ID No: 3036) |
| 154 | a cgt ttc ttg gag tac tC | (SEQ ID No: 3037) |
| 155 | gg ttc ctg gac aga tac T | (SEQ ID No: 3038) |
| 156 | at atc ctg gag cag gC | (SEQ ID No: 3039) |
| 157 | cac aac tat ggg gtt gA | (SEQ ID No: 3040) |
| 158 | g aga tac ttc cat aat caG | (SEQ ID No: 3041) |
| 159 | c tgc aga cac aac tac C | (SEQ ID No: 3042) |
| 160 | t aac cag gag gag aac C | (SEQ ID No: 3043) |
| 161 | ac gtg ggg gag ttc cT | (SEQ ID No: 3044) |
| 162 | ctg ggg cgg cct gtC | (SEQ ID No: 3045) |
| 163 | gg gag ttc cgg gcg T | (SEQ ID No: 3046) |
| 164 | ca cgt ttc ttg gag tac T | (SEQ ID No: 3047) |
| 165 | tct acg tct gag tgt caA | (SEQ ID No: 3048) |
| 166 | ggg cgg cct gat gcT | (SEQ ID No: 3049) |
| 167 | t ttc ttg gag tac tct aC | (SEQ ID No: 3050) |
| 168 | gac ata ctg gag cag G | (SEQ ID No: 3051) |
| 169 | g acg gag cgg gtg CA | (SEQ ID No: 3052) |
| 170 | g gcc gag gtg gac aaT | (SEQ ID No: 3053) |
| 171 | ttg gag tac cct acg tC | (SEQ ID No: 3054) |
| 172 | t aac cag gag gag ttc C | (SEQ ID No: 3055) |

TABLE 21-6-continued

| Probe No. | Base Sequence | |
|---|---|---|
| 173 | gg gcc gag gtg gac G | (SEQ ID No: 3056) |
| 174 | c tcc cca ctg gct ttg T | (SEQ ID No: 3057) |
| 175 | gc aga cac aac tat ggA | (SEQ ID No: 3058) |
| 176 | cac aac tac gga gtt gtG | (SEQ ID No: 3059) |
| 177 | g tgg cag cct aag agG | (SEQ ID No: 3060) |
| 178 | tg gac aga tac ttc tat aaT | (SEQ ID No: 3061) |
| 179 | cgg ttc ctg gac aga C | (SEQ ID No: 3062) |
| 180 | ac ttc ctg gag cag gC | (SEQ ID No: 3063) |

TABLE 21-7

| Probe No. | Base Sequence | |
|---|---|---|
| 181 | g gag ttc cgg gcg gC | (SEQ ID No: 3064) |
| 182 | c tgg aac agc tag aag A | (SEQ ID No: 3065) |
| 183 | ac gtg ggg gag ttc cA | (SEQ ID No: 3066) |
| 184 | c tgg aac agc ca ggg gac A | (SEQ ID No: 3067) |
| 185 | tc ctg gaa gac agg gC | (SEQ ID No: 3068) |
| 186 | g cgg gtg cgg ttc cC | (SEQ ID No: 3069) |
| 187 | c tat aac cag gag gag aA | (SEQ ID No: 3070) |
| 188 | cgt ttc ttg gag ctg cG | (SEQ ID No: 3071) |
| 189 | c tcc cga ctg gct ttC | (SEQ ID No: 3072) |
| 190 | ca cgt ttc ttg gag ctg T | (SEQ ID No: 3073) |
| 191 | cgt ttc ttg gag ctg tG | (SEQ ID No: 3074) |
| 192 | g gtg cgg tac ctg gaG | (SEQ ID No: 3075) |
| 193 | gt ttc tcg gag ctg cG | (SEQ ID No: 3076) |
| 194 | cgg gtg cgg tat ctg A | (SEQ ID No: 3077) |
| 195 | ac cag gag gag tac gC | (SEQ ID No: 3078) |
| 196 | c cag gag gag ttc ctg A | (SEQ ID No: 3079) |
| 197 | ca cgt ttc ttg G | (SEQ ID No: 3080) |
| 198 | cgg ttc ctg gag aga C | (SEQ ID No: 3081) |
| 199 | gtg gac aat tac tgc agG | (SEQ ID No: 3082) |
| 200 | ggg cgg cct gat gcG | (SEQ ID No: 3083) |
| 201 | aga cac ttc cat aac caG | (SEQ ID No: 3084) |
| 202 | ac cag gag gag aac gC | (SEQ ID No: 3085) |
| 203 | g gag cgg gtg cgg C | (SEQ ID No: 3086) |
| 204 | cac aac tac ggg gtt gC | (SEQ ID No: 3087) |
| 205 | gc aga cac aac tac ggC | (SEQ ID No: 3088) |
| 206 | g ctg aca gtg aca ttg aC | (SEQ ID No: 3089) |

TABLE 21-7-continued

| Probe No. | Base Sequence | |
|---|---|---|
| 207 | cgg gcc gag gtg gG | (SEQ ID No: 3090) |
| 208 | ag tgt gag tgt cat ttc C | (SEQ ID No: 3091) |
| 209 | g gag cga gtg tgg aaC | (SEQ ID No: 3092) |
| 210 | g gac acc tac tgc aga T | (SEQ ID No: 3093) |

TABLE 21-8

| Probe No. | Base Sequence | |
|---|---|---|
| 211 | cg cgc tac aac agt gaT | (SEQ ID No: 3094) |
| 212 | gg gcc gag gtg gac aA | (SEQ ID No: 3095) |
| 213 | tg gac aac tac tgc aga T | (SEQ ID No: 3096) |
| 214 | acg gag cga gtg tgg A | (SEQ ID No: 3097) |
| 215 | a ggt tcc tac atg gca aA | (SEQ ID No: 3098) |
| 216 | ca cgt ttc ttg C | (SEQ ID No: 3099) |
| 217 | atc tat aac caa gag gag A | (SEQ ID No: 3100) |
| 218 | cgg ttc ctg cac aga G | (SEQ ID No: 3101) |
| 219 | gac ttc ctg gaa gac aC | (SEQ ID No: 3102) |
| 220 | c ctg gaa gac acg cgC | (SEQ ID No: 3103) |
| 221 | g aag gac atc ctg gaa G | (SEQ ID No: 3104) |
| 222 | ag aag gac ttc ctg gaa A | (SEQ ID No: 3105) |
| 223 | g cct gac gcc gag tC | (SEQ ID No: 3106) |
| 224 | ag gac ttc ctg gag cG | (SEQ ID No: 3107) |
| 225 | c gag gtg gac acc gtG | (SEQ ID No: 3108) |
| 226 | ctc cct gga ggt tcc tA | (SEQ ID No: 3109) |

TABLE 22-1

| Probe No. | Base Sequence | |
|---|---|---|
| 0 | g ttg ctg gaA aga tgc at | (SEQ ID No: 3110) |
| 1 | ctg gaa aga Tgc atc tat a | (SEQ ID No: 3111) |
| 2 | gag gag tCc gtg cgc | (SEQ ID No: 3112) |
| 3 | cgg cct gaT gcc gag | (SEQ ID No: 3113) |
| 4 | cct gat gcC gag tac tg | (SEQ ID No: 3114) |
| 5 | c ggg gtt gGt gag agc | (SEQ ID No: 3115) |
| 6 | caa gag gaA tcc gtg cg | (SEQ ID No: 3116) |
| 7 | g gac acc taT tgc aga ca | (5EQ ID No: 3117) |
| 8 | c tac ggg gCt gtg gag | (SEQ ID No: 3118) |
| 9 | gg gcc gcC gtg gac | (SEQ ID No: 3119) |
| 10 | cag aag gac Atc ctg gaa | (SEQ ID No: 3120) |

TABLE 22-1-continued

| Probe No. | Base Sequence | |
|---|---|---|
| 11 | g gaa gac Gag cgg gc | (SEQ ID No: 3121) |
| 12 | gaa gac gAg cgg gcc | (SEQ ID No: 3122) |
| 13 | g gtg gac aaT tac tgc ag | (SEQ ID No: 3123) |
| 14 | ggg gtt gtG gag agc t | (SEQ ID No: 3124) |
| 15 | c gac gtg Agg gag tac | (SEQ ID No: 3125) |
| 16 | gag cag gCg cgg gc | (SEQ ID No: 3126) |
| 17 | ttc ttg tgg Gag ctt aag | (SEQ ID No: 3127) |
| 18 | a gag gag tAc gtg cgc | (SEQ ID No: 3128) |
| 19 | gag cag Gcg cgg gc | (SEQ ID No: 3129) |
| 20 | gag cag aAg cgg gcc | (SEQ ID No: 3130) |
| 21 | xc acc Aga c | (SEQ ID No: 3131) |
| 22 | g gtg cgg tAc ctg gac | (SEQ ID No: 3132) |
| 23 | g gtg gac aAc tac tgc a | (SEQ ID No: 3133) |
| 24 | cgg ggc cGg gtg ga | (SEQ ID No: 3134) |
| 25 | g ttc ctg gaG aga tac tt | (SEQ ID No: 3135) |
| 26 | aga tac ttc Cat aac cag g | (SEQ ID No: 3136) |
| 27 | g gag gag Aac gtg cgc | (SEQ ID No: 3137) |
| 28 | g gag gag aAc gtg cgc | (SEQ ID No: 3138) |
| 29 | cat aac caG gag gag tc | (SEQ ID No: 3139) |
| 30 | ggg gag tTc cgg gcg | (SEQ ID No: 3140) |

TABLE 22-2

| Probe No. | Base Sequence | |
|---|---|---|
| 31 | agc ttc acG gtg cag c | (SEQ ID No: 3141) |
| 32 | g tac ctg gaC aga tac tt | (SEQ ID No: 3142) |
| 33 | g cct gat gAg gag tac t | (SEQ ID No: 3143) |
| 34 | cct gat gaG gag tac tg | (SEQ ID No: 3144) |
| 35 | c cat aac cGg gag gag | (SEQ ID No: 3145) |
| 36 | cgg cct gCt gcg gag | (SEQ ID No: 3146) |
| 37 | g cgg ggc Cag cta ga | (SEQ ID No: 3147) |
| 38 | cgg ggc cAg gtg gac | (SEQ ID No: 3148) |
| 39 | cgg cct aGc gcc gag | (SEQ ID No: 3149) |
| 40 | cgg cct agC gcc gag | (SEQ ID No: 3150) |
| 41 | t gcc gag tCc tgg aac | (SEQ ID No: 3151) |
| 42 | g gag ttc Tgg gcg gtg | (SEQ ID No: 3152) |
| 43 | ag tac tct aCg tct gag t | (SEQ ID No: 3153) |
| 44 | g ttc ctg gaC aga tac tt | (SEQ ID No: 3154) |
| 45 | gcg gtg aGg gag ctg | (SEQ ID No: 3155) |

TABLE 22-2-continued

| Probe No. | Base Sequence | |
|---|---|---|
| 46 | c gac gtg Cgg gag ttc | (SEQ ID No: 3156) |
| 47 | ag aag gac Atc ctg gag | (SEQ ID No: 3157) |
| 48 | g gag gag tTc gtg cgc | (SEQ ID No: 3158) |
| 49 | aga tac ttc Gat aac cag g | (SEQ ID No: 3159) |
| 50 | c cat aac caG gag gag ta | (SEQ ID No: 3160) |
| 51 | g gag gag tAc gtg cgc | (SEQ ID No: 3161) |
| 52 | gt ctg aag Ttc cct gga | (SEQ ID No: 3162) |
| 53 | t cac caa gaA gag tac gt | (SEQ ID No: 3163) |
| 54 | cag gtt aaa Cat gag tgt c | (SEQ ID No: 3164) |
| 55 | cgg gcc gAg gtg gac | (SEQ ID No: 3165) |
| 56 | cct gac gcT gag tac tg | (SEQ ID No: 3166) |
| 57 | ag gtt aaa cAt gag tgt ca | (SEQ ID No: 3167) |
| 58 | tac ttc tat Cac caa gag g | (SEQ ID No: 3168) |
| 59 | tac gtg cgG ttc gac ag | (SEQ ID No: 3169) |
| 60 | gg cag agA cgg gcc | (SEQ ID No: 3170) |

TABLE 22-3

| Probe No. | Base Sequence | |
|---|---|---|
| 61 | g cag gtt aaA cat gag tg | (SEQ ID No: 3171) |
| 62 | cgg gcc cTg gtg gac | (SEQ ID No: 3172) |
| 63 | cag aag gac Ttc ctg gaa | (SEQ ID No: 3173) |
| 64 | ctg gaa gaC agg cgg g | (SEQ ID No: 3174) |
| 65 | ct gat gcc Cag tac tgg | (SEQ ID No: 3175) |
| 66 | t gtg gag agA ttc aca gt | (SEQ ID No: 3176) |
| 67 | ctg gag cGg agg cgg | (SEQ ID No: 3177) |
| 68 | g cgg gcc Ctg gtg ga | (SEQ ID No: 3178) |
| 69 | gg cct gat Acc gag tac | (SEQ ID No: 3179) |
| 70 | g gcg gtg aTg gag ctg | (SEQ ID No: 3180) |
| 71 | g tac cgg gTg gtg acg | (SEQ ID No: 3181) |
| 72 | cag agg cAg gcc gcg | (SEQ ID No: 3182) |
| 73 | g tac gtg cAc ttc gac a | (SEQ ID No: 3183) |
| 74 | cag gtt aaa Cct gag tgt | (SEQ ID No: 3184) |
| 75 | ag gtt aaa cCt gag tgt c | (SEQ ID No: 3185) |
| 76 | gtg ggg gaC tac cgg | (SEQ ID No: 3186) |
| 77 | g cct gat gGc gag tac | (SEQ ID No: 3187) |
| 78 | a gag gag Aac gtg cgc | (SEQ ID No: 3188) |
| 79 | a gag gag aAc gtg cgc | (SEQ ID No: 3189) |

TABLE 22-3-continued

| Probe No. | Base Sequence | |
|---|---|---|
| 80 | xacc cAa c | (SEQ ID No: 3190) |
| 81 | gac acc gtG tgc aga c | (SEQ ID No: 3191) |
| 82 | g cag ggt aaA tat aag tgt | (SEQ ID No: 3192) |
| 83 | acg gag ctA ggg cgg | (SEQ ID No: 3193) |
| 84 | c gcc gag tCc tgg aac | (SEQ ID No: 3194) |
| 85 | c ctg gaa agT ctc ttc ta | (SEQ ID No: 3195) |
| 86 | g aac agc cGg aag gac | (SEQ ID No: 3196) |
| 87 | cct gct gcG gag tac t | (SEQ ID No: 3197) |
| 88 | g cta ggg Tgg cct gtc | (SEQ ID No: 3198) |
| 89 | ggt gag tgt Tat ttc ttc a | (SEQ ID No: 3199) |
| 90 | tg gac aga taT ttc tat aac | (SEQ ID No: 3200) |

TABLE 22-4

| Probe No. | Base Sequence | |
|---|---|---|
| 91 | g tgt ctg aGg ctc cct | (SEQ ID No: 3201) |
| 92 | gcg gtg acA gag ctg g | (SEQ ID No: 3202) |
| 93 | c ggg gtt gTt gag agc | (SEQ ID No: 3203) |
| 94 | cgg cct gTt gcc gag | (SEQ ID No: 3204) |
| 95 | t gcg gag Cac tgg aac | (SEQ ID No: 3205) |
| 96 | g tac tct aCg ggt gag t | (SEQ ID No: 3206) |
| 97 | cgg cct gCt gcc gag | (SEQ ID No: 3207) |
| 98 | g tac tct aGg ggt gag t | (SEQ ID No: 3208) |
| 99 | a gag gag Gac gtg cgc | (SEQ ID No: 3209) |
| 100 | cgg cct aTc gcc gag | (SEQ ID No: 3210) |
| 101 | c tct acg tCt gag tgt c | (SEQ ID No: 3211) |
| 102 | ag tac tct aTg ggt gag t | (SEQ ID No: 3212) |
| 103 | ggg gct gtG gag agc | (SEQ ID No: 3213) |
| 104 | gtg cgg taT ctg cac ag | (SEQ ID No: 3214) |
| 105 | gg agg cgT gcc gcg | (SEQ ID No: 3215) |
| 106 | gaa aga cgc Gtc cat aac | (SEQ ID No: 3216) |
| 107 | gg agg cgC gcc gcg | (SEQ ID No: 3217) |
| 108 | c ctg gaa Gac agg cgc | (SEQ ID No: 3218) |
| 109 | ctg gaa gaC agg cgc g | (SEQ ID No: 3219) |
| 110 | ac agg cgC gcc gcg | (SEQ ID No: 3220) |
| 111 | ttc ttc aaC ggg acg ga | (SEQ ID No: 3221) |
| 112 | ac tct acg Ggt gag tgt | (SEQ ID No: 3222) |
| 113 | c cat aac caG gag gag aa | (SEQ ID No: 3223) |
| 114 | c cat aac caG gag gag tt | (SEQ ID No: 3224) |

TABLE 22-4-continued

| Probe No. | Base Sequence | |
|---|---|---|
| 115 | a gag gag tTc gtg cgc | (SEQ ID No: 3225) |
| 116 | c tat aac caG gag gag tt | (SEQ ID No: 3226) |
| 117 | g gag gac Ttg cgc ttc | (SEQ ID No: 3227) |
| 118 | c ctg gaa Gac agg cgg | (SEQ ID No: 3228) |
| 119 | t acg tct gaG tgt cat ttc | (SEQ ID No: 3229) |
| 120 | ttc ctg gaA gac agg cg | (SEQ ID No: 3230) |

TABLE 22-5

| Probe No. | Base Sequence | |
|---|---|---|
| 121 | tc ttg gag cTg ctt aag t | (SEQ ID No: 3231) |
| 122 | g cct gat gAg gag cac | (SEQ ID No: 3232) |
| 123 | at gag gag Cac tgg aac | (SEQ ID No: 3233) |
| 124 | cgg gcc gTg gtg gac | (SEQ ID No: 3234) |
| 125 | t gat gag gaC tac tgg aa | (SEQ ID No: 3235) |
| 126 | t gat gag gGg tat tgg a | (SEQ ID No: 3236) |
| 127 | c atg gca gtT ctg aca gt | (SEQ ID No: 3237) |
| 128 | gtg cgg ttA ctg gag ag | (SEQ ID No: 3238) |
| 129 | g gag gag Ctc ctg cg | (SEQ ID No: 3239) |
| 130 | c atc ctg gGa gac agg | (SEQ ID No: 3240) |
| 131 | gtg cgg ttC ctg gag a | (SEQ ID No: 3241) |
| 132 | gag cgg gcT gcg gtg | (SEQ ID No: 3242) |
| 133 | gaa gac gAg cgc gcc | (SEQ ID No: 3243) |
| 134 | ac gag cgC gcc gcg | (SEQ ID No: 3244) |
| 135 | ctg gaa gaC aag cgg g | (SEQ ID No: 3245) |
| 136 | g gaa gac aAg cgg gcc | (SEQ ID No: 3246) |
| 137 | g gag tac tCt acg tct g | (SEQ ID No: 3247) |
| 138 | gac aga tac Ttc tat aac c | (SEQ ID No: 3248) |
| 139 | c ggg gtt gAt gag agc | (SEQ ID No: 3249) |
| 140 | ac aac tac Cgg gtt gtg | (SEQ ID No: 3250) |
| 141 | cgg cct gTc gcc gag | (SEQ ID No: 3251) |
| 142 | g gag aac Ctg cgc ttc | (SEQ ID No: 3252) |
| 143 | g gag ttc cTg gcg gtg | (SEQ ID No: 3253) |
| 144 | cgg cct gtC gcc gag | (SEQ ID No: 3254) |
| 145 | c cgg gcg Ttg acg ga | (SEQ ID No: 3255) |
| 146 | ttg gag tac Tct acg tct | (SEQ ID No: 3256) |
| 147 | ct gag tgt caA ttc ttc aat | (SEQ ID No: 3257) |
| 148 | cct gat gcT gag tac tg | (SEQ ID No: 3258) |

TABLE 22-5-continued

| Probe No. | Base Sequence | |
|---|---|---|
| 149 | gt ttc ttg gAg tac tct ac | (SEQ ID No: 3259) |
| 150 | g cgg gtg cAg ttc ctg | (SEQ ID No: 3260) |

TABLE 22-6

| Probe No. | Base Sequence | |
|---|---|---|
| 151 | c gac gtg Cgg gag tac | (SEQ ID No: 3261) |
| 152 | c cct acg tCt gag tgt c | (SEQ ID No: 3262) |
| 153 | g gag gag tTc ctg cgc | (SEQ ID No: 3263) |
| 154 | g gag ttc Ctg cgc ttc | (SEQ ID No: 3264) |
| 155 | g gtg gac Gcc tat tgc | (SEQ ID No: 3265) |
| 156 | g gct ttg Tct ggg gac | (SEQ ID No: 3266) |
| 157 | c aac tac ggA gtt gtg ga | (SEQ ID No: 3267) |
| 158 | gga gtt gtG gag agc tt | (SEQ ID No: 3268) |
| 159 | cct aag agG gag tgt ca | (SEQ ID No: 3269) |
| 160 | c ttc tat aaT cag gag gag | (SEQ ID No: 3270) |
| 161 | ctg gac aga Cac ttc tat | (SEQ ID No: 3271) |
| 162 | ag aag gac Ttc ctg gag | (SEQ ID No: 3272) |
| 163 | cgg gcg gCg acg ga | (SEQ ID No: 3273) |
| 164 | gc cag aag Aac atc ctg | (SEQ ID No: 3274) |
| 165 | g gag ttc cAg gcg gtg | (SEQ ID No: 3275) |
| 166 | caa gg gac Atc ctg gag c | (SEQ ID No: 3276) |
| 167 | gac agg gCc gcc gc | (SEQ ID No: 3277) |
| 168 | g cgg ttc cCg gac aga | (SEQ ID No: 3278) |
| 169 | g gag ctg cGt aag tct g | (SEQ ID No: 3279) |
| 170 | ctg gct ttC gct ggg g | (SEQ ID No: 3280) |
| 171 | ttg gag ctg Tgt aag tct | (SEQ ID No: 3281) |
| 172 | g gag ctg tGt aag tct g | (SEQ ID No: 3282) |
| 173 | g tac ctg gaG aga tac tt | (SEQ ID No: 3283) |
| 174 | cgg tac ctg Aac aga tac | (SEQ ID No: 3284) |
| 175 | gag cag aAg cgg ggc | (SEQ ID No: 3285) |
| 176 | g gag tac gCg cgc ttc | (SEQ ID No: 3286) |
| 177 | ag ttc ctg Agc ttc gac | (SEQ ID No: 3287) |
| 178 | cgt ttc ttg Gag ctg ctt | (SEQ ID No: 3288) |
| 179 | ctg gag aga Cac ttc cat | (SEQ ID No: 3289) |
| 180 | t tac tgc agG cac aac ta | (SEQ ID No: 3290) |

TABLE 22-7

| Probe No. | Base Sequence | |
|---|---|---|
| 181 | cct gat gcG gag tac tg | (SEQ ID No: 3291) |
| 182 | g gag gag Aac gcg cg | (SEQ ID No: 3292) |
| 183 | g gag aac gCg cgc ttc | (SEQ ID No: 3293) |
| 184 | cgt ttc ttg Cag ctg ctt | (SEQ ID No: 3294) |
| 185 | g gtg cgg Ctc ctg ga | (SEQ ID No: 3295) |
| 186 | c ggg gtt gCt gag agc | (SEQ ID No: 3296) |
| 187 | aac tac ggC gtt gtg ga | (SEQ ID No: 3297) |
| 188 | g aca ttg aCg gtg ctg a | (SEQ ID No: 3298) |
| 189 | c gag gtg gGc acc tac | (SEQ ID No: 3299) |
| 190 | gtg tgg aaC ctg atc ag | (SEQ ID No: 3300) |
| 191 | g gac acc taT tgc aga ta | (SEQ ID No: 3301) |
| 192 | aac agt gaT ctg ggg ga | (SEQ ID No: 3302) |
| 193 | tac tgc aga Tac aac tac g | (SEQ ID No: 3303) |
| 194 | tgt cat ttc Ctc aat ggg | (SEQ ID No: 3304) |
| 195 | ga gtg tgg Aac ctg atc | (SEQ ID No: 3305) |
| 196 | c atg gca aAg ctg aca g | (SEQ ID No: 3306) |
| 197 | cgt ttc ttg Cag cag gat | (SEQ ID No: 3307) |
| 198 | ctg cac aga Ggc atc tat | (8EQ ID No: 3308) |
| 199 | gaa gac aCg cgc gcc | (SEQ ID No: 3309) |
| 200 | ac acg cgC gcc gcg | (SEQ ID No: 3310) |
| 201 | c ctg gaa Aac agg cgc | (SEQ ID No: 3311) |
| 202 | a ggt tcc tAc atg gca g | (SEQ ID No: 3312) |
| 203 | tgt ttc ttg Cag cag gat | (SEQ ID No: 3313) |

TABLE 23-1

| Allele Number | Probe Number for Detection | | | | | | |
|---|---|---|---|---|---|---|---|
| DRB1*010101 | 0 | 2 | 3 | 4 | 5 | | |
| DRB1*010102 | 6 | | | | | | |
| DRB1*010201 | 7 | 8 | | | | | |
| DRB1*010202 | 9 | | | | | | |
| DRB1*0103 | 10 | 11 | 12 | | | | |
| DRB1*0104 | 13 | 14 | | | | | |
| DRB1*0105 | 15 | | | | | | |
| DRB1*0106 | 16 | 14 | | | | | |
| DRB1*0107 | 17 | | | | | | |
| DRB1*0108 | 18 | | | | | | |
| DRB1*0109 | 19 | 16 | | | | | |
| DRB1*0110 | 20 | | | | | | |
| DRB1*030101 | 21 | 22 | 23 | 24 | 25 | 26 | 27 | 14 |
| DRB1*030102 | 26 | 28 | 14 | | | | |
| DRB1*030201 | 29 | 30 | 31 | 23 | 24 | 26 | 27 |
| DRB1*030202 | 30 | 23 | 24 | 26 | 28 | | |
| DRB1*0303 | 30 | 31 | 23 | 24 | 26 | 27 | 14 |
| DRB1*0304 | 21 | 22 | 32 | 25 | 26 | 27 | 14 |
| DRB1*030501 | 21 | 22 | 23 | 24 | 25 | 26 | 27 |
| DRB1*030502 | 27 | 33 | | | | | |
| DRB1*0306 | 21 | 34 | 22 | 23 | 24 | 26 | 27 | 14 |
| DRB1*0307 | 22 | 23 | 24 | 25 | 26 | 27 | |
| DRB1*0308 | 23 | 35 | 36 | 26 | 27 | 14 | |
| DRB1*0309 | 37 | | | | | | |
| DRB1*0310 | 38 | 26 | 27 | 14 | | | |
| DRB1*0311 | 21 | 39 | 40 | 41 | 14 | | |
| DRB1*0312 | 42 | 26 | 27 | 14 | | | |
| DRB1*0313 | 43 | 26 | 27 | 14 | | | |
| DRB1*0314 | 21 | 22 | 23 | 24 | 25 | 26 | |
| DRB1*0315 | 21 | 22 | 23 | 24 | 25 | 26 | 14 |

TABLE 23-2

| Allele Number | Probe Number for Detection | | | | | | |
|---|---|---|---|---|---|---|---|
| DRB1*0316 | 44 | | | | | | |
| DRB1*0317 | 45 | 46 | 18 | 47 | 48 | | |
| DRB1*0318 | 49 | 14 | | | | | |
| DRB1*0319 | 10 | 26 | 27 | 14 | | | |
| DRB1*0320 | 27 | 8 | | | | | |
| DRB1*0321 | 50 | 25 | 26 | 27 | 14 | | |
| DRB1*0322 | 51 | | | | | | |
| DRB1*0323 | 37 | 14 | | | | | |
| DRB1*0324 | 25 | 39 | 40 | 48 | 14 | | |
| DRB1*0325 | 21 | 22 | 32 | 52 | 25 | 26 | 27 | 14 |
| DRB1*040101 | 53 | 20 | | | | | |
| DRB1*040102 | 54 | | | | | | |
| DRB1*0402 | 53 | 12 | 14 | | | | |
| DRB1*040301 | 55 | 56 | 57 | 14 | | | |
| DRB1*040302 | 55 | 58 | 57 | 14 | | | |
| DRB1*0404 | 53 | 14 | | | | | |
| DRB1*040501 | 55 | 59 | 60 | 56 | 61 | | |
| DRB1*040502 | 62 | | | | | | |
| DRB1*040503 | 63 | | | | | | |
| DRB1*040504 | 60 | 42 | 33 | | | | |
| DRB1*0406 | 55 | 60 | 57 | 14 | | | |
| DRB1*040701 | 55 | 56 | 57 | | | | |
| DRB1*040702 | 64 | | | | | | |
| DRB1*0408 | 65 | 55 | 59 | 60 | 56 | | |
| DRB1*0409 | 60 | 61 | 20 | | | | |
| DRB1*0410 | 60 | 56 | 61 | 14 | | | |
| DRB1*0411 | 53 | 57 | 14 | | | | |
| DRB1*0412 | 60 | 61 | 10 | 66 | 14 | | |
| DRB1*0413 | 60 | 20 | 14 | | | | |
| DRB1*0414 | 60 | 10 | 11 | 12 | | | |

TABLE 23-3

| Allele Number | Probe Number for Detection | | | | |
|---|---|---|---|---|---|
| DRB1*0415 | 55 | 36 | 67 | 68 | 14 |
| DRB1*0416 | 69 | | | | |
| DRB1*0417 | 60 | 61 | 57 | | |
| DRB1*0418 | 60 | 10 | 66 | 14 | |
| DRB1*0419 | 65 | 55 | 59 | 60 | |
| DRB1*0420 | 60 | 57 | | | |
| DRB1*0421 | 60 | 20 | | | |
| DRB1*0422 | 60 | 56 | 26 | 27 | 14 |
| DRB1*0423 | 70 | | | | |
| DRB1*0424 | 61 | 42 | 71 | | |
| DRB1*0425 | 60 | 56 | 67 | 66 | 14 |
| DRB1*0426 | 72 | | | | |
| DRB1*0427 | 56 | 57 | 8 | | |
| DRB1*0428 | 60 | 56 | 25 | 61 | |
| DRB1*0429 | 73 | | | | |
| DRB1*0430 | 74 | | | | |
| DRB1*0431 | 55 | 60 | 56 | 75 | 76 |
| DRB1*0432 | 77 | | | | |
| DRB1*0433 | 78 | | | | |
| DRB1*0434 | 55 | 79 | 56 | 20 | |
| DRB1*0435 | 55 | 25 | 20 | | |
| DRB1*0436 | 55 | 67 | 68 | 14 | |
| DRB1*0437 | 55 | 80 | 81 | 14 | |
| DRB1*0438 | 55 | 10 | 82 | | |
| DRB1*0439 | 83 | | | | |
| DRB1*0440 | 84 | | | | |
| DRB1*0441 | 55 | 85 | 86 | 57 | 14 |

TABLE 23-3-continued

| Allele Number | Probe Number for Detection | | | |
|---|---|---|---|---|
| DRB1*0442 | 55 | 25 | 14 | |
| DRB1*0443 | 55 | 60 | 25 | |
| DRB1*0444 | 60 | 56 | 13 | 14 |

TABLE 23-4

| Allele Number | Probe Number for Detection | | | | |
|---|---|---|---|---|---|
| DRB1*070101 | 87 | 88 | 89 | | |
| DRB1*070102 | 90 | 91 | 92 | 89 | |
| DRB1*0703 | 93 | | | | |
| DRB1*0704 | 91 | 48 | | | |
| DRB1*0705 | 94 | | | | |
| DRB1*0706 | 91 | 95 | 89 | | |
| DRB1*0707 | 96 | | | | |
| DRB1*080101 | 97 | 42 | 67 | 66 | 33 |
| DRB1*080102 | 98 | | | | |
| DRB1*080201 | 99 | 33 | | | |
| DRB1*080202 | 97 | 18 | 67 | 66 | |
| DRB1*080203 | 100 | | | | |
| DRB1*080302 | 45 | 97 | 61 | 10 | 66 |
| DRB1*080401 | 97 | 18 | 67 | 66 | 14 |
| DRB1*080402 | 18 | 67 | 66 | 101 | |
| DRB1*080403 | 66 | 101 | 102 | | |
| DRB1*080404 | 66 | 14 | 103 | | |
| DRB1*0805 | 97 | 61 | 67 | 68 | |
| DRB1*0806 | 61 | 67 | 66 | 14 | |
| DRB1*0807 | 104 | 67 | 66 | 33 | |
| DRB1*0808 | 38 | 105 | 66 | | |
| DRB1*0809 | 45 | 50 | 67 | 66 | 33 |
| DRB1*0810 | 97 | 61 | 10 | 66 | 14 |
| DRB1*0811 | 38 | 66 | 33 | | |
| DRB1*0812 | 10 | 66 | 8 | | |
| DRB1*0813 | 97 | 18 | 66 | 33 | |
| DRB1*0814 | 106 | | | | |
| DRB1*0815 | 107 | 10 | 66 | | |
| DRB1*0816 | 108 | 33 | | | |
| DRB1*0817 | 25 | 61 | 67 | 66 | |

TABLE 23-5

| Allele Number | Probe Number for Detection | | | | |
|---|---|---|---|---|---|
| DRB1*0818 | 45 | 97 | 61 | 10 | 109 |
| DRB1*0819 | 110 | 10 | 66 | | |
| DRB1*0820 | 111 | 18 | 67 | 66 | 14 |
| DRB1*0821 | 112 | | | | |
| DRB1*0822 | 8 | 113 | 114 | | |
| DRB1*0823 | 15 | 66 | | | |
| DRB1*0824 | 97 | 18 | 67 | 68 | |
| DRB1*090102 | 92 | 115 | | | |
| DRB1*0902 | 58 | 115 | | | |
| DRB1*100101 | 116 | | | | |
| DRB1*100102 | 117 | 118 | | | |

TABLE 23-5-continued

| Allele Number | Probe Number for Detection | | | | | |
|---|---|---|---|---|---|---|
| DRB1*110101 | 99 | 36 | 67 | 68 | | |
| DRB1*110102 | 36 | 67 | 68 | 33 | | |
| DRB1*110103 | 36 | 67 | 119 | 68 | 120 | |
| DRB1*110104 | 121 | 18 | 25 | 35 | 67 | 68 |
| DRB1*1102 | 35 | 10 | 11 | 12 | 14 | |
| DRB1*1103 | 99 | 122 | 14 | | | |
| DRB1*110401 | 99 | 67 | 68 | 14 | | |
| DRB1*110402 | 36 | 14 | 103 | | | |
| DRB1*1105 | 123 | 35 | 36 | 67 | 68 | |
| DRB1*110601 | 36 | 67 | 68 | 8 | | |
| DRB1*110602 | 36 | 67 | 68 | 7 | 8 | |
| DRB1*1107 | 35 | 36 | 26 | 27 | 14 | |
| DRB1*110801 | 18 | 25 | 35 | 124 | | |
| DRB1*110802 | 36 | 124 | 33 | | | |
| DRB1*1109 | 32 | 23 | 24 | 25 | 35 | 67 | 68 |
| DRB1*1110 | 22 | 32 | 50 | 25 | 35 | 67 | 68 |
| DRB1*1111 | 25 | 35 | 67 | 125 | 122 | |
| DRB1*111201 | 126 | 25 | 35 | 67 | 68 | |
| DRB1*111202 | 111 | 127 | 128 | 25 | 35 | 67 | 68 |

TABLE 23-6

| Allele Number | Probe Number for Detection | | | | | |
|---|---|---|---|---|---|---|
| DRB1*1113 | 25 | 35 | 36 | 71 | 7 | 14 |
| DRB1*1114 | 35 | 10 | 11 | 12 | | |
| DRB1*1115 | 129 | 36 | 67 | 119 | 68 | |
| DRB1*1116 | 23 | 35 | 10 | 11 | 12 | 14 |
| DRB1*1117 | 111 | 35 | 36 | 130 | 131 | 14 |
| DRB1*1118 | 18 | 35 | 10 | 109 | 14 | |
| DRB1*1119 | 18 | 35 | 10 | 109 | | |
| DRB1*1120 | 23 | 35 | 10 | 11 | 12 | |
| DRB1*1121 | 11 | 12 | 8 | | | |
| DRB1*1122 | 55 | 25 | 36 | 67 | 68 | |
| DRB1*1123 | 35 | 36 | 67 | 68 | 132 | 66 |
| DRB1*1124 | 108 | 36 | 67 | 119 | 68 | |
| DRB1*1125 | 36 | 67 | 66 | 14 | | |
| DRB1*1126 | 133 | 134 | 18 | 25 | 35 | |
| DRB1*112701 | 135 | 68 | 13 | | | |
| DRB1*112702 | 35 | 68 | 136 | | | |
| DRB1*1128 | 134 | 137 | 138 | 25 | 35 | 67 | 68 |
| DRB1*1129 | 45 | 111 | 134 | 25 | 35 | 67 | 68 |
| DRB1*1130 | 139 | 68 | | | | |
| DRB1*1131 | 35 | 140 | 10 | 109 | | |
| DRB1*1132 | 35 | 36 | 67 | 68 | 141 | |
| DRB1*1133 | 142 | | | | | |
| DRB1*1134 | 18 | 25 | 35 | 14 | | |
| DRB1*1135 | 142 | 14 | | | | |
| DRB1*1136 | 25 | 35 | 80 | 81 | 14 | |
| DRB1*1137 | 45 | 111 | 134 | 18 | 35 | 67 | 68 |
| DRB1*1138 | 143 | | | | | |
| DRB1*1139 | 144 | 68 | | | | |
| DRB1*1140 | 23 | 25 | 35 | 67 | 125 | 122 | 14 |
| DRB1*1141 | 35 | 67 | 125 | 122 | 14 | |

TABLE 23-7

| Allele Number | Probe Number for Detection | | | | | | |
|---|---|---|---|---|---|---|---|
| DRB1*1142 | 18 | 25 | 35 | 124 | 14 | | |
| DRB1*1143 | 144 | 68 | 14 | | | | |
| DRB1*120101 | 145 | 146 | 147 | 148 | 92 | 10 | 7 | 8 |
| DRB1*120102 | 145 | 146 | 147 | 148 | 92 | 10 | 8 | |
| DRB1*120201 | 148 | 67 | 7 | 8 | | | |
| DRB1*120202 | 148 | 67 | 120 | 8 | | | |
| DRB1*120302 | 147 | 148 | 92 | 10 | 120 | | |
| DRB1*1204 | 148 | 36 | 10 | 7 | 8 | | |
| DRB1*1205 | 147 | 92 | 10 | 7 | 8 | | |
| DRB1*1206 | 147 | 148 | 92 | 10 | 7 | 8 | |
| DRB1*1207 | 149 | | | | | | |
| DRB1*1208 | 150 | 148 | 92 | 10 | 7 | 8 | |
| DRB1*130101 | 46 | 23 | 24 | 25 | 10 | 11 | 12 | 14 |

TABLE 23-7-continued

| Allele Number | Probe Number for Detection | | | | | | | | |
|---|---|---|---|---|---|---|---|---|---|
| DRB1*130102 | 151 | | | | | | | | |
| DRB1*130103 | 12 | 7 | 14 | | | | | | |
| DRB1*130201 | 46 | 23 | 24 | 25 | 10 | 11 | 12 | | |
| DRB1*130202 | 12 | 152 | | | | | | | |
| DRB1*130301 | 42 | 109 | 153 | 33 | | | | | |
| DRB1*130302 | 61 | 109 | 153 | | | | | | |
| DRB1*1304 | 25 | 61 | 11 | 12 | 14 | | | | |
| DRB1*1305 | 134 | 32 | 23 | 25 | 67 | 68 | | | |
| DRB1*1306 | 46 | 23 | 25 | 10 | 109 | 14 | | | |
| DRB1*130701 | 154 | 45 | 111 | 134 | 46 | 155 | 18 | 67 | 119 | 68 |
| DRB1*130702 | 111 | 46 | 155 | 18 | 58 | 67 | 119 | 68 | |
| DRB1*1308 | 46 | 50 | 11 | 12 | 14 | | | | |
| DRB1*1309 | 24 | 25 | 10 | 156 | 14 | | | | |
| DRB1*1310 | 46 | 23 | 25 | 10 | 109 | 153 | 14 | | |
| DRB1*1311 | 18 | 25 | 67 | 68 | 14 | | | | |
| DRB1*1312 | 111 | 61 | 10 | 109 | | | | | |

TABLE 23-8

| Allele Number | Probe Number for Detection | | | | | | | |
|---|---|---|---|---|---|---|---|---|
| DRB1*1313 | 111 | 61 | 10 | 66 | | | | |
| DRB1*131401 | 18 | 25 | 67 | 119 | 68 | | | |
| DRB1*131402 | 25 | 58 | 67 | 119 | 68 | | | |
| DRB1*1315 | 30 | 25 | 11 | 12 | 14 | | | |
| DRB1*1316 | 157 | | | | | | | |
| DRB1*1317 | 97 | 12 | 14 | | | | | |
| DRB1*1318 | 23 | 25 | 67 | 66 | 14 | | | |
| DRB1*1319 | 30 | 50 | 11 | 12 | 14 | | | |
| DRB1*1320 | 46 | 23 | 24 | 25 | 80 | 81 | 14 | |
| DRB1*1321 | 111 | 25 | 61 | 67 | 68 | | | |
| DRB1*1322 | 111 | 46 | 18 | 25 | 10 | 11 | 12 | 14 |
| DRB1*1323 | 11 | 12 | 33 | | | | | |
| DRB1*1324 | 25 | 67 | 125 | 122 | 14 | | | |
| DRB1*1325 | 154 | 45 | 111 | 134 | 46 | 18 | 25 | 124 |
| DRB1*1326 | 31 | 158 | 23 | 24 | 58 | 67 | 119 | 68 | 120 |
| DRB1*1327 | 21 | 11 | 12 | 14 | | | | |
| DRB1*1328 | 159 | | | | | | | |
| DRB1*1329 | 46 | 23 | 24 | 25 | 80 | 81 | | |
| DRB1*1330 | 25 | 61 | 10 | 109 | | | | |
| DRB1*1331 | 104 | 10 | 11 | 12 | | | | |
| DRB1*1332 | 23 | 61 | 11 | 12 | 14 | | | |
| DRB1*1333 | 61 | 109 | 136 | | | | | |
| DRB1*1334 | 160 | 11 | 12 | | | | | |
| DRB1*1335 | 161 | | | | | | | |
| DRB1*1336 | 46 | 23 | 24 | 10 | 11 | 12 | | |
| DRB1*1337 | 109 | 153 | 33 | | | | | |
| DRB1*1338 | 61 | 11 | 12 | | | | | |
| DRB1*1339 | 43 | 10 | 11 | 12 | | | | |
| DRB1*1340 | 46 | 23 | 24 | 10 | 11 | 12 | 14 | |

TABLE 23-9

| Allele Number | Probe Number for Detection | | | | | | |
|---|---|---|---|---|---|---|---|
| DRB1*1341 | 21 | 11 | 12 | | | | |
| DRB1*1342 | 23 | 67 | 68 | 14 | | | |
| DRB1*1343 | 25 | 38 | 80 | 81 | 14 | | |
| DRB1*1344 | 111 | 134 | 46 | 18 | 25 | 14 | |
| DRB1*1345 | 25 | 38 | 10 | 11 | 12 | | |
| DRB1*1346 | 18 | 104 | 162 | 67 | 135 | 68 | |
| DRB1*1347 | 111 | 18 | 67 | 66 | 33 | | |
| DRB1*1348 | 61 | 11 | 12 | 14 | | | |
| DRB1*1349 | 111 | 61 | 67 | 68 | | | |
| DRB1*1350 | 134 | 137 | 25 | 67 | 68 | | |
| DRB1*1351 | 163 | | | | | | |
| DRB1*1352 | 46 | 32 | 52 | 25 | 10 | 11 | 12 | 14 |
| DRB1*1353 | 30 | 24 | 11 | 12 | 14 | | |
| DRB1*1354 | 92 | 125 | 122 | 14 | | | |
| DRB1*1355 | 111 | 42 | 67 | 66 | 33 | | |
| DRB1*140101 | 99 | 111 | 130 | 131 | 14 | | |

TABLE 23-9-continued

| Allele Number | Probe Number for Detection | | | | | |
|---|---|---|---|---|---|---|
| DRB1*140102 | 164 | 111 | 38 | 130 | 14 | |
| DRB1*1402 | 99 | 158 | 23 | 24 | | |
| DRB1*1403 | 99 | 23 | 66 | | | |
| DRB1*1404 | 99 | 97 | 130 | 131 | 14 | |
| DRB1*140501 | 165 | 166 | 131 | 14 | | |
| DRB1*140502 | 165 | 131 | 14 | | | |
| DRB1*1406 | 45 | 30 | 23 | 24 | 14 | |
| DRB1*140701 | 164 | 111 | 38 | 130 | 131 | |
| DRB1*140702 | 38 | 131 | 33 | | | |
| DRB1*1408 | 164 | 111 | 107 | 130 | 131 | 14 |
| DRB1*1409 | 167 | 134 | 46 | 22 | 32 | 23 |
| DRB1*1410 | 59 | 38 | 130 | 131 | 14 | |
| DRB1*1411 | 97 | 35 | 36 | 130 | 131 | 14 |
| DRB1*1412 | 30 | 23 | 24 | 66 | 14 | |

TABLE 23-10

| Allele Number | Probe Number for Detection | | | | | |
|---|---|---|---|---|---|---|
| DRB1*1413 | 30 | 23 | 24 | 61 | | |
| DRB1*1414 | 111 | 50 | 130 | 131 | | |
| DRB1*1415 | 97 | 50 | 67 | 66 | 14 | |
| DRB1*1416 | 38 | 10 | 11 | 12 | 14 | |
| DRB1*1417 | 134 | 46 | 22 | 23 | 25 | 14 |
| DRB1*1418 | 23 | 24 | 166 | 130 | 131 | 14 |
| DRB1*1419 | 29 | 45 | 30 | 23 | 24 | 20 |
| DRB1*1420 | 133 | 150 | 30 | 50 | 14 | |
| DRB1*1421 | 46 | 22 | 23 | 25 | 20 | 14 |
| DRB1*1422 | 50 | 38 | 105 | 67 | 135 | 68 |
| DRB1*1423 | 164 | 111 | 50 | 130 | 131 | 14 |
| DRB1*1424 | 30 | 158 | 23 | 24 | 10 | 168 | 156 |
| DRB1*1425 | 111 | 18 | 38 | 105 | 67 | 135 | 68 |
| DRB1*1426 | 169 | 14 | | | | |
| DRB1*1427 | 30 | 23 | 24 | 67 | 68 | 132 | 66 |
| DRB1*1428 | 38 | 8 | 113 | | | |
| DRB1*1429 | 30 | 158 | 23 | 24 | 8 | |
| DRB1*1430 | 134 | 46 | 22 | 32 | 23 | 25 |
| DRB1*1431 | 97 | 38 | 7 | 14 | | |
| DRB1*1432 | 164 | 111 | 38 | 71 | 14 | |
| DRB1*1433 | 24 | 25 | 57 | 14 | | |
| DRB1*1434 | 164 | 111 | 107 | 7 | 14 | |
| DRB1*1435 | 25 | 38 | 130 | 131 | 14 | |
| DRB1*1436 | 49 | 131 | | | | |
| DRB1*1437 | 165 | 156 | 14 | | | |
| DRB1*1438 | 38 | 170 | 14 | | | |
| DRB1*1439 | 171 | 38 | 130 | 131 | 14 | |
| DRB1*1440 | 30 | 50 | 124 | 132 | 66 | |
| DRB1*1441 | 45 | 111 | 150 | 30 | 50 | 172 |
| DRB1*1442 | 18 | 25 | 130 | 131 | | |

TABLE 23-11

| Allele Number | Probe Number for Detection | | | | | |
|---|---|---|---|---|---|---|
| DRB1*1443 | 173 | | | | | |
| DRB1*1444 | 165 | 166 | 131 | | | |
| DRB1*1445 | 165 | 10 | 131 | 14 | | |
| DRB1*150101 | 174 | | | | | |
| DRB1*150102 | 175 | 176 | | | | |
| DRB1*150103 | 177 | 7 | 14 | | | |
| DRB1*150104 | 177 | 25 | 10 | 156 | 14 | |
| DRB1*150201 | 177 | 25 | 58 | 10 | 156 | |
| DRB1*150202 | 25 | 10 | 168 | 156 | | |
| DRB1*150203 | 178 | | | | | |
| DRB1*1503 | 177 | 179 | 25 | 58 | 10 | 156 | 14 |
| DRB1*1504 | 177 | 67 | 180 | 14 | | |
| DRB1*1505 | 177 | 25 | 58 | 16 | 14 | |
| DRB1*1506 | 181 | | | | | |
| DRB1*1507 | 177 | 58 | 10 | 156 | 14 | |
| DRB1*1508 | 182 | | | | | |
| DRB1*1509 | 183 | 156 | | | | |
| DRB1*1510 | 177 | 12 | 14 | | | |
| DRB1*1511 | 177 | 58 | 10 | 156 | | |
| DRB1*1512 | 177 | 61 | 42 | 10 | 156 | 14 |
| DRB1*1513 | 177 | 25 | 58 | 184 | 156 | 14 |
| DRB1*160101 | 177 | 67 | 120 | | | |
| DRB1*160102 | 177 | 67 | 68 | | | |
| DRB1*160201 | 177 | 120 | | | | |
| DRB1*160202 | 177 | 124 | | | | |
| DRB1*1603 | 185 | | | | | |
| DRB1*1604 | 127 | 58 | 67 | 68 | 132 | 66 |
| DRB1*1605 | 177 | 10 | 120 | | | |
| DRB1*1607 | 186 | | | | | |
| DRB1*1608 | 177 | 187 | 67 | 120 | | |

TABLE 23-12

| Allele Number | Probe Number for Detection | | | | | |
|---|---|---|---|---|---|---|
| DRB3*010101 | 188 | 34 | 172 | 162 | 26 | 28 |
| DRB3*01010201 | 189 | 26 | | | | |
| DRB3*010103 | 188 | 34 | 172 | 26 | 28 | |

TABLE 23-12-continued

| Allele Number | Probe Number for Detection | | | | | |
|---|---|---|---|---|---|---|
| DRB3*010104 | 28 | 175 | | | | |
| DRB3*0102 | 190 | 191 | 34 | 172 | 162 | 26 | 28 |
| DRB3*0103 | 188 | 192 | 172 | 162 | 26 | 28 |
| DRB3*0104 | 193 | 34 | 172 | 162 | 26 | 28 |
| DRB3*0105 | 194 | 28 | | | | |
| DRB3*0106 | 188 | 34 | 50 | 162 | 26 | 28 |
| DRB3*0107 | 188 | 20 | 40 | 48 | | |
| DRB3*0108 | 188 | 23 | 24 | 162 | 26 | 28 |
| DRB3*0109 | 188 | 195 | 162 | 26 | 28 | |
| DRB3*0110 | 196 | | | | | |
| DRB3*0201 | 189 | 14 | | | | |
| DRB3*020201 | 197 | 198 | 195 | 47 | 48 | |
| DRB3*020202 | 198 | 195 | 47 | 40 | 41 | |
| DRB3*020203 | 199 | | | | | |
| DRB3*020204 | 47 | 200 | 48 | | | |
| DRB3*0203 | 198 | 201 | 47 | 48 | | |
| DRB3*0204 | 47 | 26 | 27 | 14 | | |
| DRB3*0205 | 30 | 195 | 47 | 48 | | |
| DRB3*0206 | 23 | 202 | 47 | 48 | | |
| DRB3*0207 | 47 | 104 | 162 | 48 | | |
| DRB3*0208 | 47 | 61 | 42 | 48 | | |
| DRB3*0209 | 195 | 92 | 40 | 48 | | |
| DRB3*0210 | 197 | 198 | 195 | 40 | 48 | |
| DRB3*0211 | 47 | 10 | 48 | | | |
| DRB3*0212 | 198 | 195 | 47 | 48 | | |
| DRB3*0213 | 203 | | | | | |
| DRB3*0214 | 204 | | | | | |

TABLE 23-13

| Allele Number | Probe Number for Detection | | | | | |
|---|---|---|---|---|---|---|
| DRB3*0215 | 198 | 195 | 47 | 40 | | |
| DRB3*0216 | 47 | 105 | 48 | | | |
| DRB3*0217 | 47 | 67 | 48 | | | |
| DRB3*030101 | 92 | 48 | 14 | | | |
| DRB3*030102 | 205 | | | | | |
| DRB3*0302 | 198 | 92 | 48 | 14 | | |
| DRB3*0303 | 30 | 50 | 162 | 92 | 26 | 28 |
| DRB4*010101 | 206 | | | | | |
| DRB4*0102 | 207 | | | | | |
| DRB4*010302 | 208 | 209 | 210 | | | |
| DRB4*010303 | 206 | 131 | | | | |
| DRB4*010304 | 211 | | | | | |
| DRB4*0104 | 212 | 213 | | | | |
| DRB4*0105 | 208 | 214 | | | | |
| DRB4*0106 | 208 | 209 | 210 | | | |
| DRB4*0201N | 87 | 14 | | | | |
| DRB5*010101 | 215 | | | | | |
| DRB5*010102 | 129 | 58 | 67 | 119 | 68 | |
| DRB5*0102 | 2 | 216 | 217 | 67 | 119 | 120 |
| DRB5*0103 | 218 | 219 | 220 | | | |
| DRB5*0104 | 129 | 66 | | | | |
| DRB5*0105 | 108 | 67 | 119 | 120 | | |
| DRB5*0106 | 129 | 113 | | | | |
| DRB5*0107 | 129 | 10 | 221 | 120 | | |
| DRB5*0109 | 222 | | | | | |
| DRB5*0110N | 218 | 217 | 67 | 119 | 120 | |
| DRB5*0111 | 129 | 156 | | | | |
| DRB5*0112 | 129 | 223 | 224 | 225 | | |
| DRB5*0202 | 226 | 113 | | | | |
| DRB5*0203 | 218 | 217 | 10 | 168 | 156 | |
| DRB5*0204 | 218 | 67 | 180 | 113 | | |
| DRB5*0205 | 218 | 217 | 113 | | | |

TABLE 24-1

| Allele Number | Probe Number for Detection | | | | | |
|---|---|---|---|---|---|---|
| DRB1*010101 | 0 | 1 | 2 | 3 | 4 | 5 |
| DRB1*010102 | 6 | | | | | |
| DRB1*010201 | 7 | 8 | | | | |
| DRB1*010202 | 9 | | | | | |

TABLE 24-1-continued

| Allele Number | Probe Number for Detection | | | | | | |
|---|---|---|---|---|---|---|---|
| DRB1*0103 | 10 | 11 | 12 | | | | |
| DRB1*0104 | 13 | 14 | | | | | |
| DRB1*0105 | 15 | | | | | | |
| DRB1*0106 | 16 | 14 | | | | | |
| DRB1*0107 | 17 | | | | | | |
| DRB1*0108 | 18 | | | | | | |
| DRB1*0109 | 19 | 16 | | | | | |
| DRB1*0110 | 20 | | | | | | |
| DRB1*030101 | 21 | 22 | 23 | 14 | | | |
| DRB1*030102 | 24 | 13 | 14 | | | | |
| DRB1*030201 | 21 | 25 | 23 | | | | |
| DRB1*030202 | 21 | 13 | | | | | |
| DRB1*0303 | 25 | 26 | 27 | 28 | 24 | 23 | 14 |
| DRB1*0304 | 22 | 26 | 29 | 30 | 24 | 23 | 14 |
| DRB1*030501 | 22 | 26 | 27 | 28 | 30 | 24 | 23 |
| DRB1*030502 | 23 | 31 | | | | | |
| DRB1*0306 | 22 | 32 | 26 | 27 | 28 | 24 | 23 | 14 |
| DRB1*0307 | 21 | 23 | 14 | | | | |
| DRB1*0308 | 21 | 33 | 34 | 23 | 14 | | |
| DRB1*0309 | 35 | | | | | | |
| DRB1*0310 | 36 | 24 | 23 | 14 | | | |
| DRB1*0311 | 22 | 37 | 38 | 23 | 14 | | |
| DRB1*0312 | 39 | 40 | 24 | 23 | | | |
| DRB1*0313 | 41 | 24 | 23 | 14 | | | |
| DRB1*0314 | 22 | 26 | 27 | 28 | 30 | 24 | |

TABLE 24-2

| Allele Number | Probe Number for Detection | | | | | | |
|---|---|---|---|---|---|---|---|
| DRB1*0315 | 22 | 26 | 27 | 28 | 30 | 24 | 14 |
| DRB1*0316 | 42 | | | | | | |
| DRB1*0317 | 43 | 44 | 18 | 45 | 13 | | |
| DRB1*0318 | 46 | 14 | | | | | |
| DRB1*0319 | 47 | 24 | 23 | 14 | | | |
| DRB1*0320 | 23 | 8 | | | | | |
| DRB1*0321 | 48 | 30 | 24 | 23 | 14 | | |
| DRB1*0322 | 49 | | | | | | |
| DRB1*0323 | 35 | 14 | | | | | |
| DRB1*0324 | 30 | 37 | 38 | 13 | 14 | | |
| DRB1*0325 | 22 | 26 | 50 | 51 | 30 | 24 | 23 | 14 |
| DRB1*040101 | 52 | 20 | | | | | |
| DRB1*040102 | 53 | | | | | | |
| DRB1*0402 | 52 | 12 | 14 | | | | |
| DRB1*040301 | 54 | 18 | 55 | 14 | | | |
| DRB1*040302 | 54 | 56 | 55 | 14 | | | |
| DRB1*0404 | 52 | 14 | | | | | |
| DRB1*040501 | 54 | 57 | 58 | 18 | 39 | | |
| DRB1*040502 | 59 | | | | | | |
| DRB1*040503 | 54 | 57 | 58 | 18 | 39 | | |
| DRB1*040504 | 58 | 40 | 31 | | | | |
| DRB1*0406 | 54 | 58 | 55 | 14 | | | |
| DRB1*040701 | 54 | 18 | 55 | | | | |
| DRB1*040702 | 60 | | | | | | |
| DRB1*0408 | 61 | 54 | 57 | 58 | 18 | | |
| DRB1*0409 | 58 | 39 | 20 | | | | |
| DRB1*0410 | 58 | 18 | 39 | 14 | | | |
| DRB1*0411 | 52 | 55 | 14 | | | | |
| DRB1*0412 | 58 | 39 | 10 | 62 | 14 | | |
| DRB1*0413 | 58 | 20 | 14 | | | | |

TABLE 24-3

| Allele Number | Probe Number for Detection | | | | |
|---|---|---|---|---|---|
| DRB1*0414 | 58 | 10 | 11 | 12 | |
| DRB1*0415 | 54 | 58 | 34 | 63 | 64 |
| DRB1*0416 | 65 | | | | |
| DRB1*0417 | 58 | 39 | 55 | | |
| DRB1*0418 | 58 | 10 | 62 | 14 | |
| DRB1*0419 | 61 | 54 | 57 | 58 | |
| DRB1*0420 | 58 | 55 | | | |
| DRB1*0421 | 61 | 54 | 57 | 20 | |

TABLE 24-3-continued

| Allele Number | Probe Number for Detection | | | | |
|---|---|---|---|---|---|
| DRB1*0422 | 58 | 18 | 24 | 23 | 14 |
| DRB1*0423 | 66 | | | | |
| DRB1*0424 | 39 | 40 | 67 | | |
| DRB1*0425 | 58 | 18 | 63 | 64 | 68 | 62 |
| DRB1*0426 | 69 | | | | |
| DRB1*0427 | 18 | 55 | 8 | | |
| DRB1*0428 | 58 | 18 | 30 | 39 | |
| DRB1*0429 | 70 | | | | |
| DRB1*0430 | 71 | | | | |
| DRB1*0431 | 54 | 58 | 18 | 68 | 62 |
| DRB1*0432 | 72 | | | | |
| DRB1*0433 | 73 | | | | |
| DRB1*0434 | 74 | 75 | 18 | 20 | |
| DRB1*0435 | 54 | 30 | 20 | | |
| DRB1*0436 | 54 | 63 | 64 | 14 | |
| DRB1*0437 | 54 | 11 | 12 | 14 | |
| DRB1*0438 | 54 | 47 | 20 | | |
| DRB1*0439 | 76 | | | | |
| DRB1*0440 | 77 | | | | |
| DRB1*0441 | 54 | 78 | 79 | 55 | 14 |
| DRB1*0442 | 54 | 30 | 14 | | |
| DRB1*0443 | 54 | 58 | 30 | | |

TABLE 24-4

| Allele Number | Probe Number for Detection | | | | |
|---|---|---|---|---|---|
| DRB1*0444 | 58 | 18 | 13 | 14 | |
| DRB1*070101 | 80 | 37 | 81 | | |
| DRB1*070102 | 82 | 83 | 84 | 81 | |
| DRB1*0703 | 85 | | | | |
| DRB1*0704 | 83 | 13 | | | |
| DRB1*0705 | 86 | | | | |
| DRB1*0706 | 83 | 87 | 81 | | |
| DRB1*0707 | 88 | | | | |
| DRB1*080101 | 89 | 40 | 63 | 62 | 31 |
| DRB1*080102 | 90 | | | | |
| DRB1*080201 | 91 | 31 | | | |
| DRB1*080202 | 89 | 18 | 63 | 62 | |
| DRB1*080203 | 92 | | | | |
| DRB1*080302 | 21 | 10 | 62 | | |
| DRB1*080401 | 21 | 62 | 14 | | |
| DRB1*080402 | 18 | 63 | 62 | 93 | |
| DRB1*080403 | 62 | 93 | 31 | | |
| DRB1*080404 | 62 | 14 | 31 | | |
| DRB1*0805 | 89 | 39 | 63 | 64 | |
| DRB1*0806 | 39 | 63 | 62 | 14 | |
| DRB1*0807 | 94 | 63 | 62 | 31 | |
| DRB1*0808 | 36 | 95 | 62 | | |
| DRB1*0809 | 96 | 48 | 63 | 62 | 31 |
| DRB1*0810 | 89 | 39 | 10 | 62 | 14 |
| DRB1*0811 | 97 | 62 | | | |
| DRB1*0812 | 10 | 62 | 8 | | |
| DRB1*0813 | 96 | 89 | 18 | 62 | |
| DRB1*0814 | 98 | | | | |
| DRB1*0815 | 95 | 10 | 62 | | |
| DRB1*0816 | 99 | 31 | | | |

TABLE 24-5

| Allele Number | Probe Number for Detection | | | | |
|---|---|---|---|---|---|
| DRB1*0817 | 30 | 39 | 63 | 62 | |
| DRB1*0818 | 96 | 89 | 39 | 10 | 64 |
| DRB1*0819 | 100 | 10 | 62 | | |
| DRB1*0820 | 101 | 18 | 63 | 62 | 14 |
| DRB1*0821 | 102 | | | | |
| DRB1*0822 | 8 | 103 | 31 | | |
| DRB1*0823 | 15 | 62 | | | |
| DRB1*0824 | 89 | 18 | 63 | 64 | |
| DRB1*090102 | 104 | 84 | | | |
| DRB1*0902 | 104 | 56 | | | |
| DRB1*100101 | 105 | | | | |

TABLE 24-5-continued

| Allele Number | Probe Number for Detection | | | | | |
|---|---|---|---|---|---|---|
| DRB1*100102 | 106 | 107 | | | | |
| DRB1*110101 | 91 | 34 | 63 | 64 | | |
| DRB1*110102 | 34 | 63 | 64 | 31 | | |
| DRB1*110103 | 34 | 63 | 108 | 109 | 110 | |
| DRB1*110104 | 111 | 18 | 30 | 33 | 63 | 64 |
| DRB1*1102 | 21 | 34 | 10 | 11 | 12 | 14 |
| DRB1*1103 | 91 | 12 | 14 | | | |
| DRB1*110401 | 91 | 63 | 64 | 14 | | |
| DRB1*110402 | 34 | 14 | 31 | | | |
| DRB1*1105 | 112 | 33 | 34 | 63 | 64 | |
| DRB1*110601 | 34 | 63 | 64 | 8 | | |
| DRB1*110602 | 34 | 63 | 64 | 7 | 8 | |
| DRB1*1107 | 33 | 34 | 24 | 23 | 14 | |
| DRB1*110801 | 18 | 30 | 33 | 64 | | |
| DRB1*110802 | 18 | 30 | 33 | 64 | | |
| DRB1*1109 | 113 | 27 | 28 | 30 | 33 | 63 | 64 |
| DRB1*1110 | 26 | 114 | 48 | 30 | 33 | 63 | 64 |
| DRB1*1111 | 30 | 33 | 63 | 11 | 12 | |
| DRB1*111201 | 115 | 30 | 33 | 63 | 64 | |

TABLE 24-6

| Allele Number | Probe Number for Detection | | | | | | |
|---|---|---|---|---|---|---|---|
| DRB1*111202 | 101 | 116 | 48 | 30 | 33 | 63 | 64 |
| DRB1*1113 | 21 | 30 | 33 | 67 | 7 | 14 | |
| DRB1*1114 | 21 | 34 | 10 | 11 | 12 | | |

TABLE 24-6-continued

| Allele Number | Probe Number for Detection | | | | | |
|---|---|---|---|---|---|---|
| DRB1*1115 | 117 | 34 | 63 | 118 | 64 | |
| DRB1*1116 | 27 | 33 | 10 | 11 | 12 | 14 |
| DRB1*1117 | 21 | 33 | 55 | 7 | 14 | |
| DRB1*1118 | 18 | 33 | 10 | 64 | 14 | |
| DRB1*1119 | 18 | 33 | 10 | 64 | | |
| DRB1*1120 | 27 | 33 | 10 | 11 | 12 | |
| DRB1*1121 | 33 | 10 | 11 | 12 | | |
| DRB1*1122 | 54 | 30 | 34 | 63 | 64 | |
| DRB1*1123 | 33 | 34 | 63 | 64 | 68 | 62 |
| DRB1*1124 | 99 | 34 | 63 | 118 | 64 | |
| DRB1*1125 | 34 | 63 | 62 | 14 | | |
| DRB1*1126 | 43 | 101 | 119 | 18 | 30 | 33 |
| DRB1*112701 | 120 | 64 | 13 | | | |
| DRB1*112702 | 33 | 64 | 23 | | | |
| DRB1*1128 | 119 | 78 | 79 | 30 | 33 | 63 | 64 |
| DRB1*1129 | 43 | 101 | 119 | 30 | 33 | 63 | 64 |
| DRB1*1130 | 121 | 64 | | | | |
| DRB1*1131 | 122 | 123 | 10 | 64 | | |
| DRB1*1132 | 33 | 34 | 63 | 64 | 124 | |
| DRB1*1133 | 125 | | | | | |
| DRB1*1134 | 18 | 30 | 33 | 14 | | |
| DRB1*1135 | 125 | 14 | | | | |
| DRB1*1136 | 30 | 33 | 11 | 12 | 14 | |
| DRB1*1137 | 43 | 101 | 119 | 18 | 33 | 63 | 64 |
| DRB1*1138 | 126 | | | | | |
| DRB1*1139 | 45 | 64 | | | | |
| DRB1*1140 | 27 | 30 | 33 | 63 | 11 | 12 |

TABLE 24-7

| Allele Number | Probe Number for Detection | | | | | | | |
|---|---|---|---|---|---|---|---|---|
| DRB1*1141 | 33 | 63 | 11 | 12 | 14 | | | |
| DRB1*1142 | 18 | 30 | 33 | 64 | 14 | | | |
| DRB1*1143 | 45 | 64 | 14 | | | | | |
| DRB1*120101 | 127 | 21 | 128 | 129 | 84 | 10 | 7 | 8 |
| DRB1*120102 | 127 | 21 | 128 | 129 | 84 | 10 | 8 | |
| DRB1*120201 | 129 | 63 | 7 | 8 | | | | |
| DRB1*120202 | 129 | 63 | 110 | | | | | |
| DRB1*120302 | 128 | 129 | 84 | 10 | 110 | | | |
| DRB1*1204 | 129 | 34 | 10 | 7 | | | | |
| DRB1*1205 | 128 | 84 | 10 | 7 | 8 | | | |
| DRB1*1206 | 21 | 128 | 129 | 84 | 10 | 7 | 8 | |
| DRB1*1207 | 130 | | | | | | | |
| DRB1*1208 | 131 | 129 | 84 | 10 | 7 | 8 | | |
| DRB1*130101 | 21 | 27 | 30 | 10 | 11 | 12 | 14 | |
| DRB1*130102 | 132 | | | | | | | |
| DRB1*130103 | 12 | 7 | 14 | | | | | |
| DRB1*130201 | 21 | 27 | 30 | 10 | 11 | 12 | | |
| DRB1*130202 | 133 | 134 | | | | | | |
| DRB1*130301 | 40 | 135 | 136 | 31 | | | | |
| DRB1*130302 | 39 | 135 | 136 | | | | | |
| DRB1*1304 | 21 | 40 | 10 | 11 | 12 | 14 | | |
| DRB1*1305 | 119 | 113 | 27 | 30 | 63 | 64 | | |
| DRB1*1306 | 44 | 27 | 30 | 10 | 64 | 14 | | |
| DRB1*130701 | 137 | 43 | 101 | 119 | 44 | 138 | 18 | 63 | 118 | 64 |
| DRB1*130702 | 101 | 44 | 138 | 18 | 56 | 63 | 118 | 64 |
| DRB1*1308 | 44 | 48 | 11 | 12 | 14 | | | |
| DRB1*1309 | 28 | 30 | 47 | 16 | 14 | | | |
| DRB1*1310 | 44 | 27 | 30 | 10 | 135 | 136 | 14 | |
| DRB1*1311 | 18 | 30 | 63 | 64 | 14 | | | |

TABLE 24-8

| Allele Number | Probe Number for Detection | | | | |
|---|---|---|---|---|---|
| DRB1*1312 | 101 | 39 | 10 | 64 | |
| DRB1*1313 | 101 | 39 | 10 | 62 | |
| DRB1*131401 | 18 | 30 | 63 | 118 | 64 |
| DRB1*131402 | 30 | 56 | 63 | 118 | 64 |

TABLE 24-8-continued

| Allele Number | Probe Number for Detection | | | | | | | |
|---|---|---|---|---|---|---|---|---|
| DRB1*1315 | 25 | 30 | 11 | 12 | 14 | | | |
| DRB1*1316 | 139 | | | | | | | |
| DRB1*1317 | 21 | 89 | 30 | 10 | 11 | 12 | 14 | |
| DRB1*1318 | 27 | 30 | 63 | 62 | 14 | | | |
| DRB1*1319 | 21 | 48 | 10 | 11 | 12 | 14 | | |
| DRB1*1320 | 44 | 27 | 28 | 30 | 11 | 12 | 14 | |
| DRB1*1321 | 21 | 40 | 63 | 64 | | | | |
| DRB1*1322 | 101 | 44 | 18 | 30 | 10 | 11 | 12 | 14 |
| DRB1*1323 | 11 | 12 | 31 | | | | | |
| DRB1*1324 | 30 | 63 | 11 | 12 | 14 | | | |
| DRB1*1325 | 137 | 43 | 101 | 119 | 44 | 18 | 30 | 64 |
| DRB1*1326 | 26 | 113 | 27 | 28 | 56 | 63 | 108 | 109 | 110 |
| DRB1*1327 | 22 | 11 | 12 | 14 | | | | |
| DRB1*1328 | 140 | | | | | | | |
| DRB1*1329 | 44 | 27 | 28 | 30 | 11 | 12 | | |
| DRB1*1330 | 30 | 39 | 10 | 64 | | | | |
| DRB1*1331 | 141 | 10 | 11 | 12 | | | | |
| DRB1*1332 | 27 | 39 | 11 | 12 | 14 | | | |
| DRB1*1333 | 39 | 135 | 23 | | | | | |
| DRB1*1334 | 142 | 11 | 12 | | | | | |
| DRB1*1335 | 143 | | | | | | | |
| DRB1*1336 | 44 | 27 | 28 | 10 | 11 | 12 | | |
| DRB1*1337 | 135 | 136 | 31 | | | | | |
| DRB1*1338 | 39 | 11 | 12 | | | | | |
| DRB1*1339 | 41 | 10 | 11 | 12 | | | | |

TABLE 24-9

| Allele Number | Probe Number for Detection | | | | | | |
|---|---|---|---|---|---|---|---|
| DRB1*1340 | 44 | 27 | 28 | 10 | 11 | 12 | 14 |
| DRB1*1341 | 22 | 11 | 12 | | | | |
| DRB1*1342 | 27 | 63 | 64 | 14 | | | |
| DRB1*1343 | 30 | 36 | 11 | 12 | 14 | | |
| DRB1*1344 | 101 | 119 | 44 | 18 | 30 | 14 | |
| DRB1*1345 | 30 | 36 | 10 | 11 | 12 | | |
| DRB1*1346 | 18 | 141 | 144 | 63 | 120 | 64 | |
| DRB1*1347 | 101 | 18 | 63 | 62 | 31 | | |
| DRB1*1348 | 39 | 11 | 12 | 14 | | | |
| DRB1*1349 | 101 | 39 | 63 | 64 | | | |
| DRB1*1350 | 119 | 78 | 30 | 63 | 64 | | |
| DRB1*1351 | 145 | | | | | | |
| DRB1*1352 | 44 | 50 | 51 | 30 | 10 | 11 | 12 | 14 |
| DRB1*1353 | 25 | 28 | 11 | 12 | 14 | | |
| DRB1*1354 | 84 | 11 | 12 | 14 | | | |
| DRB1*1355 | 101 | 40 | 63 | 62 | 31 | | |
| DRB1*140101 | 91 | 101 | 55 | 7 | 14 | | |
| DRB1*140102 | 146 | 101 | 36 | 67 | 55 | | |
| DRB1*1402 | 91 | 27 | 28 | | | | |
| DRB1*1403 | 91 | 27 | 62 | | | | |
| DRB1*1404 | 91 | 89 | 55 | 7 | 14 | | |
| DRB1*140501 | 147 | 148 | 7 | 14 | | | |
| DRB1*140502 | 147 | 7 | 14 | | | | |
| DRB1*1406 | 149 | 43 | 25 | 27 | 28 | 14 | |
| DRB1*140701 | 146 | 101 | 36 | 55 | 7 | | |
| DRB1*140702 | 36 | 7 | 31 | | | | |
| DRB1*1408 | 146 | 101 | 95 | 55 | 7 | 14 | |
| DRB1*1409 | 43 | 119 | 44 | 26 | 113 | 27 | |
| DRB1*1410 | 57 | 36 | 55 | 7 | 14 | | |
| DRB1*1411 | 89 | 33 | 34 | 55 | 7 | | |
| DRB1*1412 | 25 | 27 | 28 | 64 | 68 | 62 | |

TABLE 24-10

| Allele Number | Probe Number for Detection | | | | | |
|---|---|---|---|---|---|---|
| DRB1*1413 | 25 | 27 | 28 | 39 | | |
| DRB1*1414 | 146 | 101 | 48 | 55 | 7 | |
| DRB1*1415 | 89 | 48 | 63 | 62 | 14 | |
| DRB1*1416 | 48 | 36 | 10 | 11 | 12 | |
| DRB1*1417 | 119 | 44 | 26 | 27 | 30 | 14 |
| DRB1*1418 | 27 | 28 | 148 | 55 | 7 | 14 |
| DRB1*1419 | 21 | 25 | 27 | 28 | 20 | |

TABLE 24-10-continued

| Allele Number | Probe Number for Detection | | | | | |
|---|---|---|---|---|---|---|
| DRB1*1420 | 43 | 101 | 131 | 25 | 48 | |
| DRB1*1421 | 44 | 26 | 27 | 30 | 20 | |
| DRB1*1422 | 48 | 36 | 95 | 63 | 120 | 64 |
| DRB1*1423 | 146 | 101 | 48 | 55 | 7 | 14 |
| DRB1*1424 | 25 | 113 | 27 | 28 | 47 | 19 | 16 |
| DRB1*1425 | 101 | 18 | 36 | 95 | 63 | 120 | 64 |
| DRB1*1426 | 150 | 14 | | | | |
| DRB1*1427 | 25 | 27 | 28 | 63 | 64 | 68 | 62 |
| DRB1*1428 | 36 | 8 | 103 | | | |
| DRB1*1429 | 25 | 113 | 27 | 28 | 8 | |
| DRB1*1430 | 119 | 44 | 26 | 113 | 27 | 30 |
| DRB1*1431 | 89 | 36 | 7 | 14 | | |
| DRB1*1432 | 146 | 101 | 36 | 67 | 14 | |
| DRB1*1433 | 28 | 30 | 55 | 14 | | |
| DRB1*1434 | 146 | 101 | 95 | 7 | 14 | |
| DRB1*1435 | 30 | 36 | 55 | 7 | 14 | |
| DRB1*1436 | 151 | 7 | | | | |
| DRB1*1437 | 147 | 16 | 14 | | | |
| DRB1*1438 | 36 | 13 | 14 | | | |
| DRB1*1439 | 152 | 36 | 55 | 7 | 14 | |
| DRB1*1440 | 25 | 48 | 64 | 68 | 62 | |
| DRB1*1441 | 43 | 101 | 131 | 25 | 153 | 154 |
| DRB1*1442 | 18 | 30 | 55 | 7 | | |
| DRB1*1443 | 155 | | | | | |

TABLE 24-11

| Allele Number | Probe Number for Detection | | | | | |
|---|---|---|---|---|---|---|
| DRB1*1444 | 147 | 148 | 7 | | | |
| DRB1*1445 | 147 | 47 | 7 | 14 | | |
| DRB1*150101 | 156 | | | | | |
| DRB1*150102 | 157 | 158 | | | | |
| DRB1*150103 | 159 | 7 | 14 | | | |
| DRB1*150104 | 159 | 30 | 47 | 16 | 14 | |
| DRB1*150201 | 159 | 30 | 56 | 47 | 16 | |
| DRB1*150202 | 30 | 47 | 19 | 16 | | |
| DRB1*150203 | 160 | | | | | |
| DRB1*1503 | 159 | 161 | 30 | 56 | 47 | 16 | 14 |
| DRB1*1504 | 159 | 162 | 16 | 14 | | |
| DRB1*1505 | 159 | 30 | 56 | 16 | 14 | |
| DRB1*1506 | 163 | | | | | |
| DRB1*1507 | 159 | 56 | 47 | 16 | | |

TABLE 24-11-continued

| Allele Number | Probe Number for Detection | | | | |
|---|---|---|---|---|---|
| DRB1*1508 | 164 | | | | |
| DRB1*1509 | 165 | 16 | | | |
| DRB1*1510 | 159 | 12 | | | |
| DRB1*1511 | 159 | 56 | 47 | 16 | |
| DRB1*1512 | 159 | 39 | 40 | 47 | 16 | 14 |
| DRB1*1513 | 159 | 30 | 56 | 166 | 16 | 14 |
| DRB1*160101 | 159 | 63 | 110 | | |
| DRB1*160102 | 159 | 63 | 64 | | |
| DRB1*160201 | 159 | 110 | | | |
| DRB1*160202 | 159 | 64 | | | |
| DRB1*1603 | 167 | | | | |
| DRB1*1604 | 159 | 62 | | | |
| DRB1*1605 | 159 | 10 | 110 | | |
| DRB1*1607 | 168 | | | | |
| DRB1*1608 | 159 | 28 | 63 | 110 | |
| DRB3*010101 | 169 | 32 | 154 | 144 | 24 | 13 |
| DRB3*01010201 | 170 | 24 | | | |

TABLE 24-12

| Allele Number | Probe Number for Detection | | | | | |
|---|---|---|---|---|---|---|
| DRB3*010103 | 169 | 32 | 154 | 24 | 13 | |
| DRB3*010104 | 169 | 32 | 154 | 144 | 24 | 13 |
| DRB3*0102 | 171 | 172 | 32 | 154 | 144 | 24 | 13 |
| DRB3*0103 | 169 | 173 | 154 | 144 | 24 | 13 |
| DRB3*0104 | 169 | 32 | 154 | 144 | 24 | 13 |
| DRB3*0105 | 174 | 13 | | | | |
| DRB3*0106 | 169 | 32 | 48 | 144 | 24 | 13 |
| DRB3*0107 | 169 | 175 | 38 | 13 | | |
| DRB3*0108 | 169 | 27 | 28 | 144 | 24 | 13 |
| DRB3*0109 | 169 | 176 | 144 | 24 | 13 | |
| DRB3*0110 | 177 | | | | | |
| DRB3*0201 | 170 | 14 | | | | |
| DRB3*020201 | 178 | 179 | 176 | 45 | 13 | |
| DRB3*020202 | 178 | 179 | 176 | 45 | 38 | 23 |
| DRB3*020203 | 180 | | | | | |
| DRB3*020204 | 45 | 181 | 13 | | | |
| DRB3*0203 | 179 | 29 | 45 | 13 | | |
| DRB3*0204 | 45 | 24 | 23 | 14 | | |
| DRB3*0205 | 178 | 25 | 176 | 45 | 13 | |
| DRB3*0206 | 182 | 183 | 45 | 13 | | |
| DRB3*0207 | 45 | 141 | 144 | 13 | | |
| DRB3*0208 | 45 | 39 | 40 | 13 | | |
| DRB3*0209 | 176 | 84 | 38 | 13 | | |
| DRB3*0210 | 178 | 179 | 176 | 38 | 13 | |
| DRB3*0211 | 45 | 47 | 13 | | | |
| DRB3*0212 | 184 | 13 | | | | |
| DRB3*0213 | 185 | | | | | |
| DRB3*0214 | 186 | | | | | |
| DRB3*0215 | 178 | 179 | 176 | 45 | 38 | |
| DRB3*0216 | 45 | 95 | 13 | | | |
| DRB3*0217 | 45 | 162 | 13 | | | |

TABLE 24-13

| Allele Number | Probe Number for Detection | | | | | |
|---|---|---|---|---|---|---|
| DRB3*030101 | 84 | 13 | 14 | | | |
| DRB3*030102 | 187 | | | | | |
| DRB3*0302 | 179 | 48 | 84 | 175 | 38 | 13 |
| DRB3*0303 | 25 | 48 | 144 | 84 | 24 | 13 |
| DRB4*010101 | 188 | | | | | |
| DRB4*0102 | 189 | | | | | |
| DRB4*010302 | 80 | 190 | 14 | | | |
| DRB4*010303 | 188 | 191 | | | | |
| DRB4*010304 | 192 | | | | | |
| DRB4*0104 | 23 | 193 | | | | |
| DRB4*0105 | 194 | 195 | | | | |
| DRB4*0106 | 194 | 190 | 193 | | | |
| DRB4*0201N | 80 | 14 | | | | |
| DRB5*010101 | 196 | | | | | |
| DRB5*010102 | 117 | 56 | 63 | 118 | 64 | |

TABLE 24-13-continued

| Allele Number | Probe Number for Detection | | | | |
|---|---|---|---|---|---|
| DRB5*0102 | 197 | 78 | 63 | 108 | 110 |
| DRB5*0103 | 198 | 199 | 200 | | |
| DRB5*0104 | 117 | 62 | | | |
| DRB5*0105 | 99 | 63 | 108 | 110 | |
| DRB5*0106 | 117 | 103 | | | |
| DRB5*0107 | 117 | 10 | 108 | 110 | |
| DRB5*0109 | 201 | | | | |
| DRB5*0110N | 197 | 78 | 63 | 108 | 110 |
| DRB5*0111 | 117 | 16 | | | |
| DRB5*0112 | 117 | 84 | 67 | 81 | |
| DRB5*0202 | 202 | 103 | | | |
| DRB5*0203 | 198 | 78 | 47 | 19 | 16 |
| DRB5*0204 | 203 | 162 | 16 | 103 | |
| DRB5*0205 | 203 | 78 | 103 | | |

Example 13

Probes for Identification of HLA-MICA Allele

Extraction of DNA from 1 ml of human blood was performed using GFX Genomic Blood DNA Purification Kit from Amersham Biosciences in the same manner as in Example 1.

Next, quantitative PCR was carried out in the same manner as in Example 1 except that probes in Tables 25-1 and 25-2 were used and 2 μl of the mixed primers consisting of 1 μl each of respective solutions of the following primers (10 pmol/μl) and 6 μl of ultra pure water:

```
AGTGGAGCCAGTGGACCCAAGA      (SEQ ID NO: 3423)

TGATGTTTTCTTCTTACAACAAC     (SEQ ID NO: 3424)
```

After PCR amplification, referring to Amp Plot and Dissociation curves on a display of 5700 software, and to the allele-probe list 1 (Tables 27-1 and 27-2), it was identified as MICA*00201.

Example 14

Extraction of DNA from 1 ml of human blood was performed in the same way as in Example 3. PCR of human HLA-MICA was then performed in the same manner as in Example 2 except that 3 μl of the mixed primer consisting of 1 μl each of the solutions containing the following sequences at 10 pmol/μl respectively, and 12 μl of ultra pure water were used:

```
GTCTTCGTTATAACCTCACGGT      (SEQ ID NO: 3425)

GCTCGTGAGCCTGCAGGTCCTG      (SEQ ID NO: 3426)

AGTGGAGCCAGTGGACCCAAGA      (SEQ ID NO: 3427)
```

At the same time, a DNA microarray was prepared to identify the allele in the specimen described above in the same manner as in Example 2, except that probes in the probe list of Table 26-1 were used to form the probe spots respectively.

Then, hybridization was performed using the above specimen and the prepared DNA microarray in the same manner as in Example 2. The DNA microarray was air-dried and the fluorometry measurement was conducted with GenePix4000B (Axon). Referring to the allele-probe correspondence list 2 (Tables 28-1 and 28-2), it was identified as MICA*00201.

Allele list
MICA*001

(SEQ ID NO: 3428)

gtcttcgttataacctcacggtgctgtcctgggatggatctgtgcagtcagggtttctcactgaggtacatctgga tggtcagcccttcctgcgctgtgacaggcagaaatgcagggcaaagccccagggacagtgggcagaagatgtcctg ggaaataagacatgggacagagagaccagAgacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactAaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaAaatccGgcgtagtcctgaggagaac agtgcccccatggtgaatgtcacccgcagcgaggcctcagagggcaacattaccgtgacatgcagggcttctggc ttctatccctggaatatcacactgaGctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagt cattggcagacattccatgtttctgctgttgctgctNNNgctgctNNNNNNNNNNNNNNNNNNNNNattttgttatta ttattttctatgtccgttgttgtaagaagaaaacatcagctgcagagggtccagagctcgtgagcctgcaggtcct ggatcaacacccagttgggacgagtgaccacagggatgccacacagctcggatttcagcctctgatgtcagatctt gggtccactggctccact

MICA*00201

(SEQ ID NO: 3429)

gtcttcgttataacctcacggtgctgtccggggatggatctgtgcagtcagggtttctcgctgaggtacatctgga tggtcagcccttcctgcgctgtgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagt cattggcagacattccatgtttctgctgttgctgctgctgctgctgctgcttattttgttattattattt tctaCgtctgttgttgtaagaagaaaacatcagctgcagagggtccagagctcgtgagcctgcaggtcctggatca acacccagttgggacgagtgaccacagggatgccacacagctcggatttcagcctctgatgtcagatcttgggtcc actggctccact

MICA*00202

(SEQ ID NO: 3430)

gtcttcgttataacctcacggtgctgtccGggatggatctgtgcagtcagggtttctcgctgaggtacatctgga tggtcagcccttcctgcgctgtgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac -continued agtgcccccatggtgaatgtcacccgcagTgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctg

MICA*004

(SEQ ID NO: 3431)

gtcttcgttataaccctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagatttagggtctgtgagatccatgaagacaacagcaccag gagctcccagcatttctactacgatggggagctcttcctctcccaaaacgtggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccagcgtagtcctgaggagaaG agtgcccccatggtgaatgtcacccgcagcgaggcctcagagggcaacatcaccgtgacatgcagggcttccagc ttctatccccggaatatcacactgacctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagt cattggcagacattccatgtttctgctgttgctgctgctgctgctgctattttgttattattatttctatgtcc gttgttgtaagaagaaaacatcagctgcagagggtccagagctcgtgagcctgcaggtcctggatcaacacccagt tgggacgagtgaccacagggatgccacacagctcggatttcagcctctgatgtcagCtcttgggtccactggctcc act

MICA*005

(SEQ ID NO: 3432)

gtcttcgttataaccctcacggtgctgtcctgggatggatctgtgcagtcagggtttcttgctgaggtacatctgga tggtcagcccttcctgcgctAtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagatttagggtctgtgagatccatgaagacaacagcaccag gagctcccagcatttctactacgatggggagctcttcctctcccaaaacctggagactgaggaatggacaGtgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttccagc ttctatccccggaatatcacactgaCctggcgtcaggatggggtatctttgagccacgacacccagcagtgggggg atgtcctgcctgatgggaatggaacctaccagacctgggtggccaccaggatttgccGaggagaggagcagaggtt cacctgctacatggaacacagcgggaatcacagcactcaccctgtgccctct

MICA*006

(SEQ ID NO: 3433)

gtcttcgttataaccctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagatttagggtctgtgagatccatgaagacaacagcaccag gagctcccagcatttctactacgatggggagctcttcctctcccaaaacgtggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccagcAtagtcctgaggagaac agtgcccccatggtgaatgtcacccgcagcgaggcctcagagggcaacatcaccgtgacatgcagggcttccagc -continued ttctatccccggaatatcacactgacctggcgtcaggatggggtatctttgagccacgacacccagcagtgggggg
atgtcctgcctgatgggaatggaacctaccagacctgggtggccaccaggatttgccaaggagaggagcagaggtt
cacctgctacatggaacacagcgggaatcacagcactcaccctgtgccctctgggaaagtgctggtgcttcagagt
cattggcagacattccatgtttctgctgttgctgctgctgctgctattttgttattatttttctatgtcc
gttgttgtaagaagaaaacatcagctgcagagggtccagagctcgtgagcctgcaggtcctggatcaacacccagt
tgggacgagtgaccacagggatgccacacagctcggatttcagcctctgatgtcagctcttgggtccactggctcc
act MICA*00701 (SEQ ID NO: 3434)
gtcttcgttataaacctcacggtgctgtcctgggatggatctgtgcagtcagggtttctcgctgaggtacatctgga
tggtcagcccttcctgcgctgtgacaggcagaaatgcagggcaaagcccagggacagtgggcagaagatgtcctg
ggaaataagacatgggacagagagaccagggacttgacagggaacggaaaggacctcaggatgaccctggctcata
tcaaggaccagaaagaaggcttgcattccctccaggagattagggtctgtgagatccatgaagacaacagcaccag
gagctcccagcatttctactacgatggggagctcttcctctcccaaaacctggagactgaggaatggacaatgccc
cagtcctccagagctcagaccttggccatgaacgtcaggaatttcttgaaggaagatgccatgaagaccaagacac
actatcacgctatgcatgcagactgcctgcaggaactacggcgatatctaaaatccggcgtagtcctgaggagaac
agtgcccccatggtgaatgtcacccgcagTgaggcctcagagggcaacattaccgtgacatgcagggcttctggc
ttctatccctggaatatcacactgagctggcgtcaggatggggtatctttgagccacgacacccagcagtgggggg
atgtcctgcctgatgggaatggaacctaccagacctgggtggccaccaggatttgccaaggagaggagcagaggtt
cacctgctacatggaacacagcgggaatcacagcactcaccctgtgccctctgggaaagtgctggtgcttcagagt
cattggcagacattccatgtttctgctgttgctgctgctgctattttgttattattatttttctatgtccgttgtt
gtaagaagaaaacatcagctgcagagggtccag MICA*00702 (SEQ ID NO: 3435)
gtcttcgttataaacctcacggtgctgtcctgggatggatctgtgcagtcagggtttctcgctgaggtacatctgga
tggtcagcccttcctgcgctgtgacaggcagaaatgcagggcaaagcccagggacagtgggcagaagatgtcctg
ggaaataagacatgggacagagagaccagGgacttgacagggaacggaaaggacctcaggatgaccctggctcata
tcaaggaccagaaagaaggcttgcattccctccaggagattagggtctgtgagatccatgaagacaacagcaccag
gagctcccagcatttctactacgatggggagctcttcctctcccaaaacctggagactGaggaatggacaatgccc
cagtcctccagagctcagaccttggccatgaacgtcaggaatttcttgaaggaagatgccatgaagaccaagacac
actatcacgctatgcatgcagactgcctgcaggaactacggcgatatctaaaatccggcgtagtcctgaggagaac
agtgcccccatggtgaatgtcacccgcagcgaggcctcagagggcaacattaccgtgacatgcagggcttctggc
ttctatccctggaatatcacactgagctggcgtcaggatggggtatctttgagccacgacacccagcagtgggggg
atgtcctgcctgatgggaatggaacctaccagacctgggtggccaccaggatttgccaaggagaggagcagaggtt
cacctgctacatggaacacagcgggaatcacagcactcaccctgtgccctctg MICA*00801 (SEQ ID NO: 3436)
gtcttcgttataaacctcacggtgctgtcctgggatggatctgtgcagtcaggggtttcttgctgaggtacatctgga
tggtcagcccttcctgcgctatgacaggcagaaatgcagggcaaagcccagggacagtgggcagaagatgtcctg
ggaaataagacatgggacagagagaccagggacttgacagggaacggaaaggacctcaggatgaccctggctcata
tcaaggaccagaaagaaggcttgcattccctccaggagattagggtctgtgagatccatgaagacaacagcaccag
gagctcccagcatttctactacgatggggagctcttcctctcccaaaacctggagactgaggaatggacagtgccc
cagtcctccagagctcagaccttggccatgaacgtcaggaatttcttgaaggaagatgccatgaagaccaagacac -continued actatcacgctatgcatgcagactgcctgcaggaactacggcgatatctagaatccggcgtagtcctgaggagaac agtgcccccatggtgaatgtcacccgcagcgaggcctcagagggcaacatcaccgtgacatgcagggcttccagc ttctatccccggaatatcatactgacctggcgtcaggatggggtatctttgagccacgacacccagcagtgggggg atgtcctgcctgatgggaatggaacctaccagacctgggtggccaccaggatttgccgaggagaggagcagaggtt cacctgctacatggaacacagcgggaatcacagcactcaccctgtgccctctgggaaagtgctggtgcttcagagt cattggcagacattccatgtttctgctgttgctgctGgctgctgctattttttgttattattattttctatgtccgt tgttgtaagaagaaaacatcagctgcagagggtccagagctcgtgagcctgcaggtcctggatcaacacccagttg ggacgagtgaccacagggatgccacacagctcggatttcagcctctgatgtcagCtcttgggtccactggctccact

MICA*00802

(SEQ ID NO: 3437)

gtcttcgttataaacctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccggcgtagtcctgaggagaac agtgcccccatggtgaatgtcacccgcagcgaggcctcagagggcaacatcaccgtgacatgcagggcttccagc ttctatccccggaatatcatactgacctggcgtcaggatggggtatctttgagccacgacacccagcagtgggggg atgtcctgcctgatgggaatggaacctaccagacctgggtggccacTaggatttgccgaggagaggagcagaggtt cacctgctacatggaacacagcgggaatcacagcactcaccctgtgccctctgggaaagtgctggtgcttcagagt cattggcagacattccatgtttctgctgttgctgctggctgctgcTattttttgttattattattttctatgtccgt tgttgtaagaagaaaacatcagctgcagagggtccag

MICA*00803

(SEQ ID NO: 3438)

gtcttcgttataaacctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccggcgtagtcctgaggagaac agtgcccccatggtgaatgtcacccgcagcgaggcAtcagagggcaacatcaccgtgacatgcagggcttccagc ttctatccccggaatatcatactgacctggcgtcaggatggggtatctttgagccacgacacccagcagtgggggg atgtcctgcctgatgggaatggaacctaccagacctgggtggccaccaggatttgccgaggagaggagcagaggtt cacctgctacatggaacacagcgggaatcacagcactcaccctgtgccctctg

MICA*00901

(SEQ ID NO: 3439)

gtcttcgttataaacctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacGtggagactgaggaatggacagtgccc cagtcctccagagctcagaccttggccatgaacgtcaggaatttcttgaaggaagatgccatgaagaccaagacac

MICA*00902

(SEQ ID NO: 3440)

gtcttcgttataaacctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagcaacagcaccag gagctcccagcatttctactaTgatggggagctcttcctctcccaaaacgtggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccagcgtagtcctgaggagaac agtgcccccatggtgaatgtcacccgcagcgaggcctcagagggcaacatcaccgtgacatgcagggcttccagc ttctatccccggaatatcacactgacctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagt cattggcagacattccatgtttctgctgttgctgctgctgctgctattttttgttattattattttctatgtcc gttgttgtaagaagaaaacatcagctgcagagggtccagagctcgtgagcctgcaggtcctggatcaacacccagt tgggacgagtgaccacagggatgccacacagctcggatttcagcctctgatgtcagctcttgggtccactggctcc act

MICA*010

(SEQ ID NO: 3441)

gtcttccttataaacctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagcaacagcaccag gagctcccagcatttctactacgatggggagctcttcctctcccaaaacctggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccAgcgtagtcctgaggagaac agtgcccccatggtgaatgtcacccgcagcgaggcctcagagggcaacatcaccgtgacatgcagggcttccagc ttctatccccggaatatcatactgacctggcgtcaggatggggtatctttgagccacgacacccagcagtgggggg atgtcctgcctgatgggaatggaacctaccagacctgggtggccaccaggatttgccGaggagaggagcagaggtt cacctgctacatggaacacagcgggaatcacagcactcaccctgtgccctctgggaaagtgctggtgcttcagagt cattggcagacattccatgtttctgctgttgctgctgctgctgctattttttgttattattattttctatgtccgtt gttgtaagaagaaaacatcagctgcagagggtccagagctcgtgagcctgcaggtcctggatcaacacccagttgg gacgagtgaccacagggatgccacacagctcggatttcagcctctgatgtcagCtcttgggtccactggctccact

MICA*011

(SEQ ID NO: 3442)

gtcttcgttataacctcacggtgctgtccggggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccgtgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctggtggccaccaggatttgccaaggagaggagcagaggtt cacctgctacatggaacacagcgggaatcacagcactcacgctgtgccctctgggaaagtgctggtgcttcagagt cattggcagacattccatgtttctgctgttgctgctgctgctgctgctattttgttattattatttctatgtct gttgttgtaagaagaaaacatcagctgcagagggtccagagctcgtgagcctgcaggtcctggatcaacacccagt tgggacgagtgaccacagggatgccacacagctcggatttcagcctctgatgtcagctcttgggtccGctggctcc act

MICA*01201

(SEQ ID NO: 3443)

gtcttcgttataacctcacggtgctgtcctgggatggatctgtgcagtcagggtttctcactgaggtacatctgga tggtcagcccttcctgcgctgtgacaggcagaaatgcagggcaaagcccagggacagtgggcagaagatgtcctg ggaaataagacatgggacagagagaccagagacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac Tctatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctggtggccaccaggatttgccaaggagaggagcagaggtt cacctgctacatggaacacagcgggaatcacagcactcaccctgtgccctctgggaaagtgctggtgcttcagagt cattggcagacattccatgtttctgctgttgctgctgctgctattttgttattattattttctatgtccgttgtt gtaagaagaaaacatcagctgcagagggtccagagctcgtgagcctgcaggtcctggatcaacacccagttgggac gagtgaccacagggatgccacacagctcggatttcagcctctgatgtcagatcttgggtccactggctccact

MICA*01202

(SEQ ID NO: 3444)

gtcttcgttataacctcacggtgctgtcctgggatggatctgtgcagtcagggtttctcactgaggtacatctgga tggtcagcccttcctgcgctgtgacaggcagaaatgcagggcaaagcccagggacagtgggcagaagatgtcctg ggaaataagacatgggacagagagaccagagacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac tctatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcaAaggtt cacctgctacatggaacacagcgggaatcacagcactcaccctgtgccctctg

MICA*013

(SEQ ID NO: 3445)

gtcttcgttataacctcacggtgctgtccGgggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctaGaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccGaggagaggagcagaggtt cacctgctacatggaacacagcgggaatcacagcactcaccctgtgccctct

MICA*014

(SEQ ID NO: 3446)

gtcttcgttataacctcacggtgctgtccggggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatAgggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctagaatccggcgtagtcctgaggagaaG agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctct

MICA*015

(SEQ ID NO: 3447)

gtcttcgttataacctcacggtgctgtccggggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatAgggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctggaaagtgctggtgcttcagagtc attggcagacattccatgtttctgctgttgctgctgctgctgctgctgctgctatttttgttattattatttt ctacgtctgttgttgtaagaagaaaacatcagctgcagagggtccagGgctcgtgag

MICA*016

(SEQ ID NO: 3448)

gtcttcgttataacctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccagcgtagtcctgaggagaac agtgcccccatggtgaatgtcacccgcagcgaggcctcagagggcaacatcaccgtgacatgcagggcttccagc ttctatccccggaatatcatactgacctggcgtcaggatgggCtatcttgagccacgacacccagcagtggggggg atgtcctgcctgatgggaatggaacctaccagacctgggtggccaccaggatttgccgaggagaggagcagaggtt cacctgctacatggaacacagcgggaatcacagcactcaccctgtgccctctgggaaagtgctggtgcttcagagt cattggcagacattccatgtttctgctgttgctgctgctgctgctattttttgttattattattttctatgtccgtt gttgtaagaagaaaacatcagctgcagagggtccagagctcgtgagcctgcaggtcctggatcaacacccagttgg gacgagtgaccacagggatgccacacagctcggatttcagcctctgatgtcagCtcttgggtccactggctccact

MICA*017

(SEQ ID NO: 3449)

gtcttcgttataacctcacggtgctgtccggggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccGggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatcttgagccacgacacccagcagtggggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagtc attggcagacattccatgtttctgctgttgctgctgctgctgctgctgctgctattttttgttattattatttt ctacgtctgttgttgtaagaagaaaacatcagctgcagagggtccagggctcgtgag

MICA*018

(SEQ ID NO: 3450)

gtcttcgttataacctcacggtgctgtcctgggatggatctgtgcagtcagggtttctcactgaggtacatctgga tggtcagcccttcctgcgctgtgacaggcagaaatgcagggcaaagcccagggacagtgggcagaagatgtcctg ggaaataagacatgggacagagagaccagagacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactGaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatcttgagccacgacacccagcagtggggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagt cattggcagacattccatgtttctgctgttgctgctgctgctattttttgttattattattttctatgtccgttgtt gtaagaagaaaacatcagctgcagagggtccagagctcgtgagcctgcaggtcctggatcaacacccagttgggac gagtgaccacagggatgccacacagctcggatttcagcctctgatgtcagatcttgggtccactggctccact

MICA*019

(SEQ ID NO: 3451)
gtcttcgttataaacctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccagcgtagtcctgaggagaac agtgcccccatggtgaatgtcacccgcagcgaggcctcagagggcaacatcaccgtgacatgcagggcttccagc ttctatccccggaatatcatactgacctggcgtcaggatggggtatctttgagccacgacacccagcagtgggggg atgtcctgcctgatgggaatggaacctaccagacctgggtggccaccaggatttgccgaggagaggagcagaggtt cacctgctacatggaacacagcgggaatcacagcactcaccctgtgccctctgggaaagtgctggtgcttcagagt cattggcagacattccatgtttctgctgttgctgctgctgctgctatttttgttattattattttctatgtccgtt gttgtaagaagaaaacatcagctgcagagggtccagagctcgtgagcctgcaggtcctggatcaacacccagttgg gacgagtgT

MICA*020

(SEQ ID NO: 3452)
gtcttcgttataaacctcacggtgctgtccggggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagt cattggcagacattccatgtttctgctgttgctgctgctgctgctgctgctgctgcTattttgttattatta ttttctacgtctgttgttgtaagaagaaaacatcagctgcagagggtccag

MICA*021

(SEQ ID NO: 3453)
gtcttcgttataaacctcacggtgctgtcctgggatggatctgtgcagtcagggtttctcactgaggtacatctgga tggtcagcccttcctgcgctgtgacaggcagaaatgcagggcaaagcccagggacagtgggcagaagatgtcctg ggaaaCaagacatgggacagagagaccagagacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac tctatcacgctatgcatgcagactgcctgcaggaactacggcgatatctaaaatccggcgtagtcctgaggagaac -continued agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctg

MICA*022 (SEQ ID NO: 3454)

gtcttcgttataaacctcacggtgctgtccGgggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccAgcgtagtcctgaggagaac agtgcccccatggtgaatgtcacccgcagcgaggcctcagagggcaacatcaccgtgacatgcagggcttccagc ttctatccccggaatatcatactgacctggcgtcaggatggggtatctttgagccacgacacccagcagtgggggg atgtcctgcctgatgggaatggaacctaccagacctgggtggccaccaggatttgccGaggagaggagcagaggtt cacctgctacatggaacacagcgggaatcacagcactcaccctgtgccctctg

MICA*023 (SEQ ID NO: 3455)

gtcttcgttataaacctcacggtgctgtccGgggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagt cattggcagacattccatgtttctgctgttgctgctGgctgctgctattttgttattattattttctatgtccgt tgttgtaa

MICA*024 (SEQ ID NO: 3456)

gtcttcgttataaacctcacggtgctgtcctgggatggatctgtgcagtcagggtttctTgctgaggtacatctgga tggtcagcccttcctgcgctAtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaGtgccc cagtcctccagagctcagaccttggccatgaacgtcaggaatttcttgaaggaagatgccatgaagaccaagacac actatcacgctatgcatgcagactgcctgcaggaactacggcgatatctagaatccggcgtagtcctgaggagaac agtgcccccatggtgaatgtcacccgcagcgaggcctcagagggcaacatCaccgtgacatgcagggcttccagc ttctatccccggaatatcacactgaCctggcgtcaggatggggtatctttgagccacgacacccagcagtgggggg atgtcctgcctgatgggaatggaacctaccagacctgggtggccaccaggatttgccaaggagaggagcagaggtt
cacctgctacatggaacacagcgggaatcacagcactcaccctgtgccctctg

MICA*025

(SEQ ID NO: 3457)
gtcttccttataacctcacggtgctgtcctgggatggatctgtgcagtcagggtttctTgctgaggtacatctgga
tggtcagcccttcctgcgctatgacaggcagaaatgcagggcaaagcccagggacagtgggcagaagatgtcctg
ggaaataagacatgggacagagagaccagggacttgacagggaacggaaaggacctcaggatgaccctggctcata
tcaaggaccagaaagaaggcttgcattccctccaggagattagggtctgtgagatccatgaagacaacagcaccag
gagctcccagcatttctactacgatggggagctcttcctctcccaaaacctggagactGaggaatggacaatgccc
cagtcctccagagctcagaccttggccatgaacgtcaggaatttcttgaaggaagatgccatgaagaccaagacac
actatcacgctatgcatgcagactgcctgcaggaactacggcgatatctaaaatccggcgtagtcctgaggagaac
agtgcccccatggtgaatgtcacccgcagcgaggcctcagagggcaacattaccgtgacatgcagggcttctggc
ttctatccctggaatatcacactgagctggcgtcaggatggggtatctttgagccacgacacccagcagtgggggg
atgtcctgcctgatgggaatggaacctaccagacctgggtggccaccaggatttgccaaggagaggagcagaggtt
cacctgctacatggaacacagcgggaatcacagcactcaccctgtgccctctg

MICA*026

(SEQ ID NO: 3458)
gtcttcgttataacctcacggtgctgtcctgggatggatctgtgcagtcagggtttctcgctgaggtacatctgga
tggtcagcccttcctgcgctgtgacaggcagaaatgcagggcaaagcccagggacagtgggcagaagatgtcctg
ggaaataagacatgggacagagagaccagggacttgacagggaacggaaaggacctcaggatgaccctggctcata
tcaaggaccagaaagaaggcttgcattccctccaggagattagggtctgtgagatccatgaagacaacagcaccag
gagctcccagcatttctactacgatggggagctcttcctctcccaaaacctggagactgaggaatggacaatgccc
cagtcctccagagctcagaccttggccatgaacgtcaggaatttcttgaaggaagatgccatgaagaccaagacac
actatcacgctatgcatgcagactgcctgcaggaactacggcgatatctaaaatccggcgtagtcctgaggagaac
agtgcccccatggtgaatgtcacccgcagTgaggcctcagagggcaacattaccgtgacatgcagggcttctggc
ttctatccctggaatatcacactgagctggcgtcaggatggggtatctttgagccacgacacccagcagtgggggg
atgtcctgcctgatgggaatggaacctaccagacctgggtggccaccaggatttgccaaggagaggagcagaggtt
cacctgctacatggaacacagcgggaatcacagcactcaccctgtgccctctgggaaagtgctggtgcttcagagt
cattggcagacattccatgtttctgctgttgctgctgctgctgctgcTattttttgttattattattttctatgtcc
gttgttgtaagaagaaaacatcagctgcagagggtccag

MICA*027

(SEQ ID NO: 3459)
gtcttcgttataacctcacggtgctgtcctgggatggatctgtgcagtcagggtttcttgctgaggtacatctgga
tggtcagcccttcctgcgctatgacaggcagaaatgcagggcaaagcccagggacagtgggcagaagatgtcctg
ggaaataagacatgggacagagagaccagggacttgacagggaacggaaaggacctcaggatgaccctggctcata
tcaaggaccagaaagaaggcttgcattccctccaggagattagggtctgtgagatccatgaagacaacagcaccag
gagctcccagcatttctactacgatggggagctcttcctctcccaaaacctggagactgaggaatggacagtgccc
cagtcctccagagctcagaccttggccatgaacgtcaggaatttcttgaaggaagatgccatgaagaccaagacac
actatcacgctatgcatgcagactgcctgcaggaactacggcgatatctagaatccggcgtagtcctgaggagaac
agtgcccccatggtgaatgtcacccgcagcgaggcctcagagggcaacatcaccgtgacatgcagggcttccagc
ttctatccccggaatatcaTactgacctggcgtcaggatggggtatctttgagccacgacacccagcagtgggggg
atgtcctgcctgatgggaatggaacctaccagacctgggtggccaccaggatttgccgaggagaggagcagaggtt
cacctgctacatggaacacagcgggaatcacagcactcaccctgtgccctctgggaaagtgctggtgcttcagagt -continued cattggcagacattccatgtttctgctgttgctgctgctgctgcTattttgttattattattttctatgtccgtt gttgtaagaagaaaacatcagctgcagagggtccag MICA*028 (SEQ ID NO: 3460)
gtcttcgttataacctcacggtgctgtcctgggatggatctgtgcagtcagggtttcttgctgaggtacatctgga tggtcagcccttcctgcgctatgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctaGaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagt cattggcagacattccatgtttctgctgttgctgctGgctgctgctattttgttattattattttctatgtccgt tgttgtaa MICA*029 (SEQ ID NO: 3461)
gtcttcgttataacctcacggtgctgtcctgggatggatctgtgcagtcagggtttctcgctgaggtacatctgga tggtcagcccttcctgcgctgtgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacAtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagt cattggcagacattccatgtttctgctgttgctgctgctgctattttgttattattattttctatgtccgttgtt gtaagaagaaaacatcagctgcagagggtccag MICA*030 (SEQ ID NO: 3462)
gtcttcgttataacctcacggtgctgtccggggatggatctgtgcagtcagggtttctcgctgaggtacatctgga tggtcagcccttcctgcgctgtgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcacGctgtgccctctg

MICA*031

(SEQ ID NO: 3463)

gtcttcgttataacctcacggtgctgtcctgggatggatctgtgcagtcagggtttctTgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactaaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctg

MICA*032

(SEQ ID NO: 3464)

gtcttcgttataacctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac TctatcacgctatgcatgcagactgcctgcaggaactacggcgatatctaaaatccAgcgtagtcctgaggagaaG agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctg

MICA*033

(SEQ ID NO: 3465)

gtcttcgttataacctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagTctgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccagcgtagtcctgaggagaac agtgcccccatggtgaatgtcacccgcagcgaggcctcagagggcaacatcaccgtgacatgcagggcttccagc ttctatccccggaatatcatactgacctggcgtcaggatggggtatctttgagccacgacacccagcagtgggggg atgtcctgcctgatgggaatggaacctaccagacctgggtggccaccaggatttgccgaggagaggagcagaggtt cacctgctacatggaacacagcgggaatcacagcactcaccctgtgccctctgggaaagtgctggtgcttcagagt cattggcagacattccatgtttctgctgttgctgctgctgctgctatttttgttattattattttctatgtccgtt gttgtaagaagaaaacatcagctgcagagggtccag

MICA*034

(SEQ ID NO: 3466)

gtcttcgttataacctcacggtgctgtccggggatggatctgtgcagtcagggtttctcgctgaggtacatctgga tggtcagcccttcctgcgctgtgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccGtgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacatcaccgtgacatgcagggcttccagc ttctatccccggaatatcacactgaCctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctg

MICA*035

(SEQ ID NO: 3467)

gtcttcgttataacctcacggtgctgtccGgggatggatctgtgcagtcagggtttctcgctgaggtacatctgga tggtcagcccttcctgcgctgtgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacatcaccgtgacatgcagggcttccagc ttctatccccggaatatcaTactgacctggcgtcaggatggggtatctttgagccacgacacccagcagtgggggg atgtcctgcctgatgggaatggaacctaccagacctgggtggccaccaggatttgccgaggagaggagcagaggtt cacctgctacatggaacacagcgggaatcacagcactcaccctgtgccctctg

MICA*036

(SEQ ID NO: 3468)

gtcttcgttataacctcacggtgctgtccggggatggatctgtgcagtcagggtttctcgctgaggtacatctgga tggtcagcccttcctgcgctgtgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccaA gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctagaatccagcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctg

MICA*037

(SEQ ID NO: 3469)

gtcttcgttataacctcacggtgctgtcctggggatggatctgtgcagtcagggtttctcgctgaggtacatctgga tggtcagcccttcctgcgctgtgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacatcaccgtgacatgcagggcttccagc ttctatccccggaatatcaTactgacctggcgtcaggatggggtatctttgagccacgacacccagcagtgggggg atgtcctgcctgatgggaatggaacctaccagacctgggtggccaccaggatttgccgaggagaggagcagaggtt cacctgctacatggaacacagcgggaatcacagcactcaccctgtgccctctg MICA*038
(SEQ ID NO: 3470)
gtcttcgttataaacctcacggtgctgtcctgggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacatCaccgtgacatgcagggcttccagc ttctatccccggaatatcacactgacctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctg MICA*039
(SEQ ID NO: 3471)
gtcttcgttataaacctcacggtgctgtcctgggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacatcaccgtgacatgcagggcttccagc ttctatccccggaatatcactgacctggcgtcaggatgggCtatctttgagccacgacacccagcagtgggggg atgtcctgcctgatgggaatggaacctaccagacctgggtggccaccaggatttgccgaggagaggagcagaggtt cacctgctacatggaacacagcgggaatcacagcactcaccctgtgccctctg MICA*040
(SEQ ID NO: 3472)
gtcttcgttataaacctcacggtgctgtcctgggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagGgacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactaaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc -continued ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctg

MICA*041 (SEQ ID NO: 3473)

gtcttcgttataacctcacggtgctgtccggggatggatctgtgcagtcagggtttctcgctgaggGacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagcaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagt cattggcagacattccatgtttctgctgttgctgctgctgctgctgctgctgctattttttgttattattattt tctaCgtctgttgttgtaagaagaaaacatcagctgcagagggtccag

MICA*042 (SEQ ID NO: 3474)

gtcttcgttataacctcacggtgctgtcctgggatggatctgtgcagtcagggtttcttgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacatcaccgtgacatgcagggcttccagc ttctatccccggaatatcatactgacctggcgtcaggatggggtatctttgagccacgacacccagcagtgggggg atgtcctgcctgatgggaatggaacctaccagacctgggtggccacTaggatttgccgaggagaggagcagaggtt cacctgctacatggaacacagcgggaatcacagcactcaccctgtgccctctg

MICA*043 (SEQ ID NO: 3475)

gtcttcgttataacctcacggtgctgtcctgggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac gctatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgccaaggagaggagcagagTtt cacctgctacatggaacacagcgggaatcacagcactcaccctgtgccctctgggaaagtgctggtgcttcagagt cattggcagacattccatgtttctgctgttgctgctgctgctattttgttattattattttctatgtctgttgtt gtaagaagaaaacatcagctgcagagggtccag

MICA*044

(SEQ ID NO: 3476)

gtcttcgttataacctcacggtgctgtccGgggatggatctgtgcagtcagggtttctcgctgaggtacatctgga tggtcagcccttcctgcgctatgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacgtggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccagcgtagtcctgaggagaaG agtgcccccatggtgaatgtcacccgcagcgaggcctcagagggcaacatcaccgtgacatgcagggcttccagc ttctatccccggaatatcacactgaCctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctg

MICA*045

(SEQ ID NO: 3477)

gtcttcgttataacctcacggtgctgtcctgggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagtgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctgggtggccaccaggatttgcGaaggagaggagcagaggtt cacctgctacatggaacacagcgggaatcacagcactcaccctgtgccctctgggaaagtgctggtgcttcagagt cattggcagacattccatgtttctgctgttgctgctgctgctattttgttattattttctatgtccgttgtt gtaagaagaaaacatcagctgcagagggtccag

MICA*046

(SEQ ID NO: 3478)

gtcttcgttataacctcacggtgctgtccggggatggatctgtgcagtcagggtttctcgctgaggtacatctgga tggtcagcccttcctgcgctgtgacaggcagaaatgcagggcaaagcccagggacagtgggcagaagatgtcctg ggaaataagacatgggacagagagaccagggacttgacagggaacggaaaggacctcaggatgaccctggctcata tcaaggaccagaaagaaggcttgcattccctccaggagattagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctGtccctggaatatcacactgagctggcgtcaggatggggtatctttgagccacgacacccagcagtgggggg atgtcctgcctgatgggaatggaacctaccagacctgggtggccaccaggatttgccaaggagaggagcagaggtt cacctgctacatggaacacagcgggaatcacagcactcaccctgtgccctctgggaaagtgctggtgcttcagagt -continued cattggcagacattccatgtttctgctgttgctgctgctgctgctgctgctgctattttgttattattattt tctacgtctgttgttgtaagaagaaaacatcagctgcagagggtccag

MICA*047

(SEQ ID NO: 3479)
gtcttcgttataacctcacggtgctgtccggggatggatctgtgcagtcagggtttctcgctgaggGacatctgga tggtcagcccttcctgcgctgtgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagatttagggtctgtgagatccatgaagacaacagcaccag gagctcccagcatttctactacgatggggagctcttcctctcccaaaacctggagactgaggaatggacaatgccc cagtcctccagagctcagaccttggccatgaacgtcaggaatttcttgaaggaagatgccatgaagaccaagacac actatcacgctatgcatgcagactgcctgcaggaactacggcgatatctaaaatccggcgtagtcctgaggagaac agtgcccccatggtgaatgtcacccgcagcgaggcctcagagggcaacattaccgtgacatgcagggcttctggc ttctatccctggaatatcacactgagctggcgtcaggatggggtatctttgagccacgacacccagcagtgggggg atgtcctgcctgatgggaatggaacctaccagacctggtggccaccaggatttgccaaggagaggagcagaggtt cacctgctacatggaacacagcgggaatcacagcactcacGctgtgccctctgggaaagtgctggtgcttcagagt cattggcagacattccatgtttctgctgttgctgctgctgctgctgctattttgttattattattttctatgtct gttgttgtaagaagaaaacatcagctgcagagggtccag

MICA*048

(SEQ ID NO: 3480)
gtcttcgttataacctcacggtgctgtcctgggatggatctgtgcagtcagggtttcttgctgaggtacatctgga tggtcagcccttcctgcgctatgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagatttagggtctgtgagatccatgaagacaacagcaccag gagctcccagcatttctactacgatggggagctcttcctctcccaaaacctggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccggcgtagtcctgaggagaac agtgcccccatggtgaatgtcacccgcagcgaggcctcagagggcaacatcaccgtgacatgcagggcttccagc ttctatccccggaatatcatactgacctggcgtcaggatggggtatctttgagccacgacacccagcagtgggggg atgtcctgcctgatgggaatggaacctaccagacctggtggccaccaggatttgccgaggagaggagcagaggtt cacctgctacatggaacacagcgggaatcacagcactcaccctgtgccctctgggaaagtgctggtgcttcagagt cattggcagacattccatgtttctgctgttgctgctgctgctgctattttgttattattattttctatgtccgtt gttgtaagaagaaaacatcagctgcagaTggtccagagctcgtgagcctgcaggtcctggatcaacacccagttgg gacgagtgaccacagggatgccacacagctcggatttcagcctctgatgtcagctcttgggtccactggctccact

MICA*049

(SEQ ID NO: 3481)
gtcttcgttataacctcacggtgctgtcctgggatggatctgtgcagtcagggtttcttgctgaggtacatctgga tggtcagcccttcctgcgctatgacaggcagaaatgcagggcaaagccccagggacagtgggcagaagatgtcctg ggaaataagacatgggacagagagaccagggacttgacagggaacggaaaggacctcaggatgaccctggctcata tcaaggaccagaaagaaggcttgcattccctccaggagatttagggtctgtgagatccatgaagacaacagcaccag gagctcccagcatttctactacgatggggagctcttcctctcccaaaacgtggagactgaggaatggacagtgccc cagtcctccagagctcagaccttggccatgaacgtcaggaatttcttgaaggaagatgccatgaagaccaagacac actatcacgctatgcatgcagactgcctgcaggaactacggcgatatctagaatccgcgtagtcctgaggagaac agtgcccccatggtgaatgtcacccgcagcgaggcctcagagggcaacatcaccgtgacatgcagggcttccagc ttctatccccggaatatcacactgacctggcgtcaggatggggtatctttgagccacgacacccagcagtgggggg -continued

```
atgtcctgcctgatgggaatggaacctaccagacctgggtggccaccaggatttgccaaggagaggagcagaggtt
cacctgctacatggaacacagcgggaatcacagcactcaccctgtgccctctgggaaagtgctggtgcttcagagt
cattggcagacattccatgtttctgctgttgctgctgctgctgctgctattttgttattattattttctatgtcc
gttgttgtaagaagaaaacatcagctgcagagggtccagagctcgtgagcctgcaggtcctggatcaacacccagt
tgggaTgagtgaccacagggatgccacacagctcggatttcagcctctgatgtcagctcttgggtccactggctcc
act
```

In the following, Probe List M1 and M2 are shown in Tables 25-1 and 25-2 and Tables 26-1 and 26- and Tables 27-1 and 27-2 and Tables 28-1 and 28-2 respectively.

TABLE 25-1

| Probe No. | Base Sequence | |
|---|---|---|
| 0 | tgg gac aga gag acc agA | (SEQ ID No: 3320) |
| 1 | tcc caa aac ctg gag act A | (SEQ ID No: 3321) |
| 2 | g gaa cta cgg cga tat cta A | (SEQ ID No: 3322) |
| 3 | cgg cga tat cta aaa tcc G | (SEQ ID No: 3323) |
| 4 | cc tgg aat atc aca ctg aG | (SEQ ID No: 3324) |
| 5 | t att ttt gtt att att att ttc taC | (SEQ ID No: 3325) |
| 6 | c ctc acg gtg ctg tcc G | (SEQ ID No: 3326) |
| 7 | gtg aat gtc acc cgc agT | (SEQ ID No: 3327) |
| 8 | c gta gtc ctg agg aga aG | (SEQ ID No: 3328) |
| 9 | t cag cct ctg atg tca gC | (SEQ ID No: 3329) |
| 10 | cag ccc ttc ctg cgc tc | (SEQ ID No: 3330) |
| 11 | gag act gag gaa tgg aca G | (SEQ ID No: 3331) |
| 12 | cc cgg aat atc aca ctg aC | (SEQ ID No: 3332) |
| 13 | gcc acc agg att tgc cG | (SEQ ID No: 3333) |
| 14 | g cga tat cta gat tcc agc A | (SEQ ID No: 3334) |
| 15 | gg gac aga gag acc agG | (SEQ ID No: 3335) |
| 16 | cc caa aac ctg gag act G | (SEQ ID No: 3336) |
| 17 | gtt tct gct gtt gct gct G | (SEQ ID No: 3337) |
| 18 | ag acc tgg gtg gcc acT | (SEQ ID No: 3338) |
| 19 | t gct gct g gct gct gcT | (SEQ ID No: 3339) |
| 20 | c acc cgc agc gag gcA | (SEQ ID No: 3340) |
| 21 | ctc ttc ctc tcc caa aac G | (SEQ ID No: 3341) |
| 22 | gc tcc cag cat ttc tac taT | (SEQ ID No: 3342) |
| 23 | cgg cga tat cta gaa tcc A | (SEQ ID No: 3343) |
| 24 | g tca gct ctt ggg tcc G | (SEQ ID No: 3344) |
| 25 | cc atg aag acc aag aca cT | (SEQ ID No: 3345) |
| 26 | tgc caa gga gag gag caA | (SEQ ID No: 3346) |
| 27 | gaa cta cgg cga tat cta G | (SEQ ID No: 3347) |
| 28 | c cag cat ttc tac tac gat A | (SEQ ID No: 3348) |

TABLE 25-1-continued

| Probe No. | Base Sequence | |
|---|---|---|
| 29 | gct gca gag ggt cca gG | (SEQ ID No: 3349) |
| 30 | c tgg cgt cag gat ggg C | (SEQ ID No: 3350) |

TABLE 25-2

| Probe No. | Base Sequence | |
|---|---|---|
| 31 | ggc ttg cat tcc ctc cG | (SEQ ID No: 3351) |
| 32 | c cca gtt ggg acg agt gT | (SEQ ID No: 3352) |
| 33 | ct gct gct gct gct gcT | (SEQ ID No: 3353) |
| 34 | a gaa gat gtc ctg gga aaC | (SEQ ID No: 3354) |
| 35 | t gtg cag tca ggg ttt ctT | (SEQ ID No: 3355) |
| 36 | gcc tca gag ggc aac atC | (SEQ ID No: 3356) |
| 37 | ct gct gct gct gct gcT | (SEQ ID No: 3357) |
| 38 | ttc tat ccc cgg aat atc aT | (SEQ ID No: 3358) |
| 39 | gtt gct gct gct gct gcT | (SEQ ID No: 3359) |
| 40 | cag acc ttg gcc atg aac A | (SEQ ID No: 3360) |
| 41 | gg aat cac agc act cac G | (SEQ ID No: 3361) |
| 42 | a cgg cga tat cta aaa tcc A | (SEQ ID No: 3362) |
| 43 | ctc tcc caa aac ctg gag T | (SEQ ID No: 3363) |
| 44 | ttc ttg aag gaa gat gcc G | (SEQ ID No: 3364) |
| 45 | cat gaa gac aac agc acc aA | (SEQ ID No: 3365) |
| 46 | ggg ttt atc gct gag gG | (SEQ ID No: 3366) |
| 47 | caa gga gag gag cag agT | (SEQ ID No: 3367) |
| 48 | g gcc acc agg att tgc G | (SEQ ID No: 3368) |
| 49 | c agg gct tct ggc ttc tG | (SEQ ID No: 3369) |
| 50 | ag aaa aca tca gct gca gaT | (SEQ ID No: 3370) |
| 51 | at caa cac cca gtt ggg aT | (SEQ ID No: 3371) |

TABLE 26-1

| Probe No. | Base Sequence | |
|---|---|---|
| 0 | a gag acc agA gac ttg aca | (SEQ ID No: 3372) |
| 1 | ctg gag act Aag gaa tgg a | (SEQ ID No: 3373) |
| 2 | cga tat cta Aaa tcc ggc g | (SEQ ID No: 3374) |
| 3 | cta aaa tcc Ggc gta gtc c | (SEQ ID No: 3375) |
| 4 | c aca ctg aGa tgg cgt c | (SEQ ID No: 3376) |
| 5 | att att ttc taC gtc tgt tgt t | (SEQ ID No: 3377) |
| 6 | tg ctg tcc Ggg gat gga | (SEQ ID No: 3378) |
| 7 | acc cgc agT gag gcc tc | (SEQ ID No: 3379) |
| 8 | g agg aga aGa gtg ccc c | (SEQ ID No: 3380) |

TABLE 26-1-continued

| Probe No. | Base Sequence | |
|---|---|---|
| 9 | tg atg tca gCt ctt ggg tc | (SEQ ID No: 3381) |
| 10 | c ctg cgc tAt gac agg c | (SEQ ID No: 3382) |
| 11 | gaa tgg aca Gtg ccc cag | (SEQ ID No: 3383) |
| 12 | c aca ctg aCc tgg cgt c | (SEQ ID No: 3384) |
| 13 | gg att tgc cGa gga gag g | (SEQ ID No: 3385) |
| 14 | gaa tcc agc Ata gtc ctg a | (SEQ ID No: 3386) |
| 15 | a gag acc agG gac ttg ac | (SEQ ID No: 3387) |
| 16 | ctg gag act Gag gaa tgg | (SEQ ID No: 3388) |
| 17 | gtt gct gct G gct gct g | (SEQ ID No: 3389) |
| 18 | g gtg gcc acT agg att tg | (SEQ ID No: 3390) |
| 19 | gct gct g gct gct gcT a | (SEQ ID No: 3391) |
| 20 | agc gag gcA tca gag gg | (SEQ ID No: 3392) |
| 21 | tcc caa aac Gtg gag act g | (SEQ ID No: 3393) |
| 22 | at ttc tac taT gat ggg gag | (SEQ ID No: 3394) |
| 23 | cta gaa tcc Agc gta gtc c | (SEQ ID No: 3395) |
| 24 | t ggg tcc Gct ggc tcc | (SEQ ID No: 3396) |
| 25 | cc aag aca cTc tat cac gc | (SEQ ID No: 3397) |
| 26 | a gag gag caA agg ttc acc | (SEQ ID No: 3398) |
| 27 | cga tat cta Gaa tcc ggc g | (SEQ ID No: 3399) |
| 28 | tac tac gat Agg gag ctc t | (SEQ ID No: 3400) |
| 29 | g ggt cca gGg ctc gtg | (SEQ ID No: 3401) |
| 30 | cag gat ggg Cta tct ttg a | (SEQ ID No: 3402) |

TABLE 26-2

| Probe No. | Base Sequence | |
|---|---|---|
| 31 | at tcc ctc cGg gag att ag | (SEQ ID No: 3403) |
| 32 | t gct gct gct gct gcT at | (SEQ ID No: 3404) |
| 33 | ct gct gct gcT att ttt gtt | (SEQ ID No: 3405) |
| 34 | c ctg gga aaC aag aca tgg | (SEQ ID No: 3406) |
| 35 | a ggg ttt ctT gct gag gta | (SEQ ID No: 3407) |
| 36 | g ggc aac atC acc gtg ac | (SEQ ID No: 3408) |
| 37 | gct gct gct gct gcT att | (SEQ ID No: 3409) |
| 38 | cgg aat atc aTa ctg acc tg | (SEQ ID No: 3410) |
| 39 | gcc atg aac Atc agg aat tt | (SEQ ID No: 3411) |
| 40 | gc act cac Gct gtg ccc | (SEQ ID No: 3412) |
| 41 | cta aaa tcc Ag gta gtc c | (SEQ ID No: 3413) |
| 42 | aac ctg gag Tct gag gaa t | (SEQ ID No: 3414) |
| 43 | gaa gat gcc Tct gag gaa t | (SEQ ID No: 3415) |
| 44 | c agc acc aAg acg tcc c | (SEQ ID No: 3416) |
| 45 | c gct gag gGa cat ctg g | (SEQ ID No: 3417) |
| 46 | g gag cag agT ttc acc tg | (SEQ ID No: 3418) |
| 47 | agg att tgc Gaa gga gag g | (SEQ ID No: 3419) |
| 48 | ct ggc ttc tGt ccc tgg a | (SEQ ID No: 3420) |
| 49 | a gct gca gaT ggt cca ga | (SEQ ID No: 3421) |
| 50 | ca gtt ggg aTg agt gac c | (SEQ ID No: 3422) |

TABLE 27-1

| Allele Number | Probe Number for Detection | | | | |
|---|---|---|---|---|---|
| MICA*001 | 0 | 1 | 2 | 3 | 4 |
| MICA*00201 | 5 | | | | |
| MICA*00202 | 6 | 7 | | | |

TABLE 27-1-continued

| Allele Number | Probe Number for Detection | | | |
|---|---|---|---|---|
| MICA*004 | 8 | 9 | | |
| MICA*005 | 10 | 11 | 12 | 13 |
| MICA*006 | 14 | | | |
| MICA*00701 | 7 | | | |
| MICA*00702 | 15 | 16 | | |
| MICA*00801 | 17 | 9 | | |
| MICA*00802 | 18 | 19 | | |
| MICA*00803 | 20 | | | |
| MICA*00901 | 21 | 9 | | |
| MICA*00902 | 22 | | | |
| MICA*010 | 23 | 13 | 9 | |
| MICA*011 | 24 | | | |
| MICA*01201 | 25 | | | |
| MICA*01202 | 26 | | | |
| MICA*013 | 6 | 27 | 13 | |
| MICA*014 | 28 | 8 | | |
| MICA*015 | 28 | 29 | | |
| MICA*016 | 30 | 9 | | |
| MICA*017 | 31 | | | |
| MICA*018 | 16 | | | |
| MICA*019 | 32 | | | |
| MICA*020 | 33 | | | |
| MICA*021 | 34 | | | |
| MICA*022 | 6 | 23 | 13 | |
| MICA*023 | 6 | 17 | | |
| MICA*024 | 35 | 10 | 11 | 36 | 12 |
| MICA*025 | 35 | 16 | | |

TABLE 27-2

| Allele Number | Probe Number for Detection | | | |
|---|---|---|---|---|
| MICA*026 | 7 | 37 | | |
| MICA*027 | 38 | 39 | | |
| MICA*028 | 27 | 17 | | |
| MICA*029 | 40 | | | |
| MICA*030 | 41 | | | |
| MICA*031 | 35 | | | |
| MICA*032 | 25 | 42 | 8 | |
| MICA*033 | 43 | | | |
| MICA*034 | 44 | 12 | | |
| MICA*035 | 6 | 38 | | |
| MICA*036 | 45 | | | |
| MICA*037 | 38 | | | |
| MICA*038 | 36 | | | |
| MICA*039 | 30 | | | |
| MICA*040 | 15 | | | |
| MICA*041 | 46 | 5 | | |
| MICA*042 | 18 | | | |
| MICA*043 | 47 | | | |
| MICA*044 | 6 | 8 | 12 | |
| MICA*045 | 48 | | | |
| MICA*046 | 49 | | | |
| MICA*047 | 46 | 41 | | |
| MICA*048 | 50 | | | |
| MICA*049 | 51 | | | |

TABLE 28-1

| Allele Number | Probe Number for Detection | | | | |
|---|---|---|---|---|---|
| MICA*001 | 0 | 1 | 2 | 3 | 4 |
| MICA*00201 | 5 | | | | |
| MICA*00202 | 6 | 7 | | | |
| MICA*004 | 8 | 9 | | | |
| MICA*005 | 10 | 11 | 12 | 13 | |
| MICA*006 | 14 | | | | |
| MICA*00701 | 7 | | | | |
| MICA*00702 | 15 | 16 | | | |
| MICA*00801 | 17 | 9 | | | |
| MICA*00802 | 18 | 19 | | | |
| MICA*00803 | 20 | | | | |
| MICA*00901 | 21 | 9 | | | |
| MICA*00902 | 22 | | | | |
| MICA*010 | 23 | 13 | 9 | | |
| MICA*011 | 24 | | | | |
| MICA*01201 | 25 | | | | |
| MICA*01202 | 26 | | | | |
| MICA*013 | 6 | 27 | 13 | | |
| MICA*014 | 28 | 8 | | | |
| MICA*015 | 28 | 29 | | | |
| MICA*016 | 30 | 9 | | | |
| MICA*017 | 31 | | | | |
| MICA*018 | 16 | | | | |
| MICA*019 | 23 | 13 | 32 | | |
| MICA*020 | 33 | | | | |

TABLE 28-2

| Allele Number | Probe Number for Detection | | | | |
|---|---|---|---|---|---|
| MICA*021 | 34 | | | | |
| MICA*022 | 6 | 23 | 13 | | |
| MICA*023 | 6 | 17 | | | |
| MICA*024 | 35 | 10 | 11 | 36 | 12 |
| MICA*025 | 35 | 16 | | | |
| MICA*026 | 7 | 37 | | | |
| MICA*027 | 38 | 32 | | | |
| MICA*028 | 27 | 17 | | | |
| MICA*029 | 39 | | | | |
| MICA*030 | 40 | | | | |
| MICA*031 | 35 | | | | |
| MICA*032 | 25 | 41 | 8 | | |
| MICA*033 | 42 | | | | |
| MICA*034 | 43 | 12 | | | |
| MICA*035 | 6 | 38 | | | |
| MICA*036 | 44 | | | | |
| MICA*037 | 38 | | | | |
| MICA*038 | 36 | | | | |
| MICA*039 | 30 | | | | |
| MICA*040 | 15 | | | | |
| MICA*041 | 45 | 5 | | | |
| MICA*042 | 18 | | | | |
| MICA*043 | 46 | | | | |
| MICA*044 | 6 | 8 | 12 | | |
| MICA*045 | 47 | | | | |
| MICA*046 | 48 | | | | |
| MICA*047 | 45 | 40 | | | |
| MICA*048 | 49 | | | | |
| MICA*049 | 50 | | | | |

The present invention is not limited to the above embodiments and various changes and modifications can be made within the spirit and scope of the present invention. Therefore, to apprise the public of the scope of the present invention, the following claims are made.

This application claims priority from Japanese Patent Application Nos. 2003-430553 filed on Dec. 25, 2003, 2003-430554 filed on Dec. 25, 2003, 2003-430555 filed on Dec. 25, 2003, 2003-430556 filed on Dec. 25, 2003, 2003-430557 filed on Dec. 25, 2003, 2003-430558 filed on Dec. 25, 2003 and 2003-430559 filed on Dec. 25, 2003, which are hereby incorporated by reference herein.

SEQUENCE LISTING (3481 sequences)

SEQ ID NO: 1 - DNA, 897 bp, Homo sapiens
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 2 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagattaccaagcgcaagtgggaggcggtccatgcggcggagcagcggagagtctacctggagggccggtgcgtggacgggctccgcagatacctggagaacgggaaggagacgctgcagcgcacgg

SEQ ID NO: 3 - DNA, 897 bp, Homo sapiens
atggccgtcatggcgccccgaaccctcctcctgctactctcgggggccctggccctgacccagacctgggcgggctcccactccatgaggtatttctccacatccgtgtcccggcccggcagtggagagccccgcttcatcgcagtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 4 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagatgatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacgg

SEQ ID NO: 5 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagttgagagcctacctggagggccggtgcgtggacgggctccgcagatacctggagaacgggaaggagacgctgcagcgcacgg

SEQ ID NO: 6 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggagaggcctgagtattgggaccaggagacacggaatgtgaaggcccactcacagactgaccgagagaacctggggaccctgcgcggctactacaaccagagcgaggccggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacgg

SEQ ID NO: 7 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggctggtgcgtggacgggctccgcagatacctggagaacgggaaggagacgctgcagcgcacgg

SEQ ID NO: 8 - DNA, 897 bp, Homo sapiens
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttagtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggacgggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 9 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 10 - DNA, 546 bp, Homo sapiens
gctcccactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 11 - DNA, 875 bp, Homo sapiens
aaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcatcgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggg

SEQ ID NO: 12 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcagcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 13 - DNA, 822 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaagacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggg

SEQ ID NO: 14 - DNA, 822 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgattcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggg

SEQ ID NO: 15 - DNA, 822 bp, Homo sapiens
gctctcactccatgaggtatttcttcacatccgtgtcccggcccggccgtggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggg

SEQ ID NO: 16 - DNA, 822 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacagagctcgtggagaccaggcctgcaggggatggaaccttccagaagtgggcggctgtggtggtgccttctggacaggagcagagatacacctgccatgtgcagcatgagggtttgcccaagcccctcaccctgagatggg

SEQ ID NO: 17 - DNA, 822 bp, Homo sapiens
gctctcactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggg

SEQ ID NO: 18 - DNA, 822 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccggaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccctccagaggatgtatggctgcgacgtggggtcggactggcgcttcctgcgcgggtaccaccagtacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggg

SEQ ID NO: 19 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggagacggcccatgaggcggagcagtggagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 20 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagatgatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 21 - DNA, 897 bp, Homo sapiens
atggccgtcatggcgccccgaaccctcgtcctgctactctcgggggctctggccctgacccagacctgggcgggctctcactccatgaggtatttctacacctccgtgtcccggcccggccgcggggagccccgcttcatcgcagtgggctacgtggacgacacgcagttcgtgcggttcgacagcgacgccgcgagccggaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccctccagaggatgtatggctgcgacgtggggtcggactggcgcttcctgcgcgggtaccaccagtacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 22 - DNA, 897 bp, Homo sapiens
atggccgtcatggcgccccgaaccctcgtcctgctactctcgggggctctggccctgacccagacctgggcgggctctcactccatgaggtatttctacacctccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 23 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtgtggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 24 - DNA, 550 bp, Homo sapiens
tgggcgggctctcactccatgaggtatttctacacctccgtgtcccggcccggccgcggggagccccgcttcatcgcagtgggctacgtggacgacacgcagttcgtgcggttcgacagcgacgccgcgagccggaggatggagccgcgggcgccgtggatagagcaggagggtccggagtattgggacggggagacacggaatgtgaaggcccactcacagactcaccgagtggacctggggaccctgcgcggctactacaaccagagcgaggccggttctcacaccctccagaggatgtatggctgcgacgtggggtcggactggcgcttcctgcgcgggtaccaccagtacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgca

SEQ ID NO: 25 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgaaggggatggaaccttccagaagtgggcggctgtggtggtgccttctggacaggagcagagatacacctgccatgtgcagcatgagggtttgcccaagcccctcaccctgagatgggag

SEQ ID NO: 26 - DNA, 897 bp, Homo sapiens
atggccgtcatggcgccccgaaccctcgtcctgctactctcgggggctctggccctgacccagacctgggcgggctctcactccatgaggtatttctacacctccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtttggctgcgacgtggggtcggacgggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 27 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagattgaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 28 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagcagagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 29 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgaggcggagcagcagagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 30 - DNA, 892 bp, Homo sapiens
cgtcatggcgccccgaaccctcgtcctgctactctcgggggctctggccctgacccagacctgggcgggctctcactccatgaggtatttctacacctccgtgtcccggcccggccgcggggagccccgcttcatcgcagtgggctacgtggacgacacgcagttcgtgcggttcgacagcgacgccgcgagccggaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccctccagaggatgtatggctgcgacgtggggtcggactggcgcttcctgcgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 31 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcgagtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 32 - DNA, 897 bp, Homo sapiens
atggccgtcatggctccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccctccagatgatgtttggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 33 - DNA, 781 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccctccagatgatgtttggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcag

SEQ ID NO: 34 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtgtggctgcgacgtggggtcggactggcgcttcctccgcgggtaccaccagtacgcctacgacggcaaggattacatcgccctgaaagaggacctgcgctcttggaccgcggcggacaaggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 35 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 36 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaatgtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 37 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaacgtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 38 - DNA, 897 bp, Homo sapiens
atggccgtcatggcgccccgaaccctcgtcctgctactctcgggggctctggccctgacccagacctgggcgggctctcactccatgaggtatttctacacctccgtgtcccggcccggccgcggggagccccgcttcatcgcagtgggctacgtggacaacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 39 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 40 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaacgaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 41 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggagacggcccatgtggcggagcagttgagagcctacctggagggcacgtgcgtggagtggctccgcagatacctggagaacgggaaggagacgctgcagcgcacgg

SEQ ID NO: 42 - DNA, 891 bp, Homo sapiens
gtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgaggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 43 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgcggcggagcagcagagagcctacctggagggcacgtgcgtggagtggctccgcagatacctggagaacgggaaggagacgctgcagcgcacgg

SEQ ID NO: 44 - DNA, 546 bp, Homo sapiens
gctctcactccatgaggtatttctacacctccgtgtcccggcccggccgcggggagccccgcttcatcgcagtgggctacgtggacgacacgcagttcgtgcggttcgacagcgacgccgcgagccagaggatggagccgcgggcgccgtggatagagcaggagagtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 45 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggcaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 46 - DNA, 897 bp, Homo sapiens
atggccgtcatggcgccccgaaccctcgtcctgctactctcgggggctctggccctgacccagacctgggcgggctctcagtccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 47 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgggagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 48 - DNA, 897 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtctggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 49 - DNA, 822 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccagtcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggg

SEQ ID NO: 50 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccagtcacagactgaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 51 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggacgggctccgcagatacctggagaacgggaaggagacgctgcagcgcacgg

SEQ ID NO: 52 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagcagagagcctacctggagggcacgtgcgtggacgggctccgcagatacctggagaacgggaaggagacgctgcagcgcacgg

SEQ ID NO: 53 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggagacggcccatgaggcggagcagcagagagcctacctggagggccggtgcgtggagtggctccgcagatacctggagaacgggaaggagacgctgcagcgcacgg

SEQ ID NO: 54 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 55 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccgtgtggcggagcagttgagagcctacctggagggcacgtgcgtggagtggctccgcagatacctggagaacgggaaggagacgctgcagcgcacgg

SEQ ID NO: 56 - DNA, 546 bp, Homo sapiens
gctctcactccatgaggtatttctacacctccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccagcagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 57 - DNA, 546 bp, Homo sapiens
gctctcactccatgaggtatttcttcacatccgtgtcccggcccggccgcggggagccccgcttcatctcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 58 - DNA, 546 bp, Homo sapiens
gctctcactccatgaggtatttctacacctccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagatcaccaagcgcaagtgggaggcggcccatgtggcggagcagcagagagcctacctggagggcacgtgcgtggagtggctccgcagatacctggagaacgggaaggagacgctgcagcgcacgg

SEQ ID NO: 59 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggaccaggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 60 - DNA, 619 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacgaggagacagggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 61 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccggaggatggagccgcgggcgccgtggatagagcaggagggtccggagtattgggacggggagacacggaaagtgaaggcccactcacagagtcaccgagtggacctggggaccctgcgcggctactacaaccagagcgaggccggttctcacaccctccagaggatgtatggctgcgacgtggggtcggactggcgcttcctgcgcgggtaccaccagtacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgg

SEQ ID NO: 62 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 63 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagcggagagcctacctggagggcacgtgcgtggagtggctccgcagatacctggagaacgggaaggagacgctgcagcgcacgg

SEQ ID NO: 64 - DNA, 546 bp, Homo sapiens
gctcccactccatgaggtatttcttcacatccatgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacggggagacacggaaagtgaaggcccactcacagactcaccgagtggacctggggaccctgcgcggctactacaaccagagcgaggccggttctcacaccatccagaggatgtatggctgcgacgtggggccggacgggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgg

SEQ ID NO: 65 - DNA, 546 bp, Homo sapiens
gctctcactccatgaggtatttctacacctccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccgtgtggcggagcagttgagagcctacctggagggcacgtgcgtggagtggctccgcagatacctggagaacgggaaggagacgctgcagcgcacgg

SEQ ID NO: 66 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggacgggcgcttcctccgcgggtatgaacagcacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 67 - DNA, 546 bp, Homo sapiens
gctctcactccatgaggtatttctacacctccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagcagagagcctacctggagggcacgtgcgtggacgggctccgcagatacctggagaacgggaaggagacgctgcagcgcacgg

SEQ ID NO: 68 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 69 - DNA, 895 bp, Homo sapiens
atggccgtcatggcgccccgaaccctcgtcctgctactctcgggggctctggccctgacccagacctgggcgggctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggaccaggagacacggaatgtgaaggcccagtcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggg

SEQ ID NO: 70 - DNA, 897 bp, Homo sapiens
atggccgtcatggcgccccgaaccctcgtcctgctactctcgggggctctggccctgacccagacctgggcgggctctcactccatgaggtatttctacacctccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccctccagatgatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 71 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccctccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 72 - DNA, 822 bp, Homo sapiens
gctctcactccatgaggtatttcttcacatccgtgtcccggcccggccgcgaggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggg

SEQ ID NO: 73 - DNA, 546 bp, Homo sapiens
gctctcactccatgaggtatttcttcacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagggtccggagtattgggacggggagacacggaaagtgaaggcccactcacagactcaccgagtggacctggggaccctgcgcggctactacaaccagagcgaggccggttctcacaccgtccagaggatgtatggctgcgacgtggggtcggactggcgcttcctccgcgggtaccaccagttcgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacgg

SEQ ID NO: 74 - DNA, 897 bp, Homo sapiens
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 75 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagctgagagcctacctggatggcacgtgcgtggagtggctccgcagatacctggagaacgggaaggagacgctgcagcgcacgg

SEQ ID NO: 76 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggagggtccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacgg

SEQ ID NO: 77 - DNA, 897 bp, Homo sapiens
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgtggcggagcagcagagagcctacctggatggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 78 - DNA, 897 bp, Homo sapiens
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaaccggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 79 - DNA, 858 bp, Homo sapiens
tctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggagggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatggg

SEQ ID NO: 80 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatgccacgtgcgtggagtggctccgcagatacctggagaacgggaaggagacgctgcagcgcacgg

SEQ ID NO: 81 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgtggcggagcagttgagagcctacctggatggcacgtgcgtggagtggctccgcagatacctggagaacgggaaggagacgctgcagcgcacgg

SEQ ID NO: 82 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccactcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacgg

SEQ ID NO: 83 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactcaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacgg

SEQ ID NO: 84 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgtggcggagcagcagagagcctacctggagggcacgtgcgtggagtggctccgcagatacctggagaacgggaaggagacgctgcagcgcacgg

SEQ ID NO: 85 - DNA, 897 bp, Homo sapiens
atggccgtcatggcgccccgaaccctcctcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccatgcggcggagcagcagagagcctacctggagggccggtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 86 - DNA, 822 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcagacatggcagctcagatcaccaagcgcaagtgggaggcggcccatgcggcggagcagcagagagcctacctggagggccggtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatggg

SEQ ID NO: 87 - DNA, 895 bp, Homo sapiens
atggccgtcatggcgccccgaaccctcctcctgctactctcgggggccctggccctgacccagacctgggcgggctcccactccatgaggtatttctacacctccgtgtcccggcccggccgcgggaagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccatgcggcggagcagcagagagcctacctggagggccggtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatggg

SEQ ID NO: 88 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccgtgaggcggagcagcagagagcctacctggagggccggtgcgtggagtggctccgcagatacctggagaacgggaaggagacgctgcagcgcacgg

SEQ ID NO: 89 - DNA, 897 bp, Homo sapiens
atggccgtcatggcgccccgaaccctcctcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccatgcggcggagcagcagagagcctacctggagggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 90 - DNA, 897 bp, Homo sapiens
atggccgtcatggcgccccgaaccctcctcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccgagcgcaagtgggaggcggcccatgcggcggagcagcagagagcctacctggagggccggtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 91 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactcaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccatgcggcggagcagcagagagcctacctggagggccggtgcgtggagtggctccgcagatacctggagaacgggaaggagacgctgcagcgcacgg

SEQ ID NO: 92 - DNA, 897 bp, Homo sapiens
atggccgtcatggcgccccgaaccctcctcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttactccgcgggtaccggcaggacgcctacgacggcaaggattacatcgccctgaacgaggacctgcgctcttggaccgcggcggacatggcagctcagatcaccaagcgcaagtgggaggcggcccatgcggcggagcagcagagagcctacctggagggccggtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 93 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccatgaggcggagcagcggagagcctacctggagggccggtgcgtggagtggctccgcagatacctggagaacgggaaggagacgctgcagcgcacgg

SEQ ID NO: 94 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccatgcggcggagcagcagagagcctacctgcagggccggtgcgtggagtggctccgcagatacctggagaacgggaaggagacgctgcagcgcacgg

SEQ ID NO: 95 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccatgcggcggagcagcagagagcctacctggagggccggtgcgtggagtggctccgcagatacctggagaacgggaaggagacgctgcagcgcacgg

SEQ ID NO: 96 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacctgcagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccatgcggcggagcagcagagagcctacctggagggccggtgcgtggagtggctccgcagatacctggagaacgggaaggagacgctgcagcgcacgg

SEQ ID NO: 97 - DNA, 546 bp, Homo sapiens
ggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccatgcggcggagcagcagagagcctacctggagggccggtgcgtggagtggctccgcagatacctggagaacgggaaggagacgctgcagcgcacg

SEQ ID NO: 98 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaggcgcaagtgggaggcggcccatgcggcggagcagcagagagcctacctggagggccggtgcgtggagtggctccgcagatacctggagaacgggaaggagacgctgcagcgcacgg

SEQ ID NO: 99 - DNA, 573 bp, Homo sapiens
ccctggccctgacccagacctgggcgggctcccactccatgaggtatttctacacctccgtgtcccggcccggccgcgggaagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggcccgtcgggcggagcagcagagagcctacctggagggccggtgcgtggagtggctccgcagatacctggagaacgggaaggagacgctgcagcgcacgg

SEQ ID NO: 100 - DNA, 897 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcacccagcgcaagtgggaggcggcccgtgtggcggagcagttgagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggag

SEQ ID NO: 101 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcacccagcgcaagtgggaggcggcccgtgtggcggagcagtggagagcctacctggagggcacgtgcgtggacgggctccgcagatacctggagaacgggaaggagacgctgcagcgcacgg

SEQ ID NO: 102 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggacgggctccgcagatacctggagaacgggaaggagacgctgcagcgcacgg

SEQ ID NO: 103 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 104 - DNA, 546 bp, Homo sapiens
gctcccactccatgaggtgtttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcacccagcgcaagtgggaggcggcccgtgtggcggagcagttgagagcctacctggagggcacgtgcgtggacgggctccgcagatacctggagaacgggaaggagacgctgcagcgcacgg

SEQ ID NO: 105 - DNA, 897 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaacgagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcacccagcgcaagtgggaggcggcccgtgtggcggagcagttgagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggag

SEQ ID NO: 106 - DNA, 897 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatatgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcacccagcgcaagtgggaggcggcccgtgtggcggagcagttgagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggag

SEQ ID NO: 107 - DNA, 897 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggag

SEQ ID NO: 108 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcagctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 109 - DNA, 897 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcagagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggag

SEQ ID NO: 110 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtatgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 111 - DNA, 897 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggagtggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggag

SEQ ID NO: 112 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggagtggctccgcagatacctggagaacgggaaggagacgctgcagcgcactg

SEQ ID NO: 113 - DNA, 897 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagcgaacctggggaccctgcgcggctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggag

SEQ ID NO: 114 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcacccagcgcaagtgggaggcggcccatgtggcggagcagcagagagcctacctggagggcacgtgcgtggacgggctccgcagatacctggagaacgggaaggagacgctgcagcgcacgg

SEQ ID NO: 115 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagtggagagcctacctggagggcacgtgcgtggacgggctccgcagatacctggagaacgggaaggagacgctgcagcgcacgg

SEQ ID NO: 116 - DNA, 897 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccagtcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggag

SEQ ID NO: 117 - DNA, 897 bp, Homo sapiens
atggccgtcatggcgccccgaaccctcgtcctgctactctcgggggccctggccctgacccagacctgggcaggctcccaatccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacggggagacacggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggag

SEQ ID NO: 118 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggccggtgcgtggagtggctccgcagatacctggagaacgggaaggagacgctgcagcgcacgg

SEQ ID NO: 119 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagttgagagcctacctggagggcacgtgcgtggacgggctccgcagatacctggagaacgggaaggagacgctgcagcgcacgg

SEQ ID NO: 120 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 121 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtatggctgcgacgtggggccggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 122 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccggcaggacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 123 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacgg

SEQ ID NO: 124 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccagtcacagactgaccgagtggacctggggaccctgcgcggctactacaaccagagcgaggacggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 125 - DNA, 546 bp, Homo sapiens
gctcccaatccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 126 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaacgaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 127 - DNA, 897 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagtggagagtctacctggagggcacgtgcgtggagtggctccgcagatacctggagaacgggaaggagacgctgcagcgcacggacccccccaagacacatatgacccaccaccccatctctgaccatgaggccactctgagatgctgggccctgggcttctaccctgcggagatcacactgacctggcagcgggatggggaggaccagacccaggacacggagcttgtggagaccaggcctgcaggggatggaaccttccagaagtgggcagctgtggtggtaccttctggagaggagcagagatacacctgccatgtgcagcatgagggtctgcccaagcccctcaccctgagatgggag

SEQ ID NO: 128 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggactggctccgcagatacctggagaacgggaaggagacgctgcagcgcacgg

SEQ ID NO: 129 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcacccagcgcaagtgggaggcggcccgtgtggcggagcagttgagagcctacctggagggcacgtgcgtggacgggctccgcagatacctggagaacgggaaggagacgctgcagcgcacgg

SEQ ID NO: 130 - DNA, 546 bp, Homo sapiens
gctcccactccatgaggtgtttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 131 - DNA, 599 bp, Homo sapiens
aaccctcctcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccacgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 132 - DNA, 619 bp, Homo sapiens
atggccgtcatggcgccccgaaccctcgtcctgctactctcgggggccctggccctgacccagacctgggcaggctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacagggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 133 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactcaccgagtggacctggggaccctgcgcggctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 134 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacacggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 135 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactcaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 136 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgagcagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 137 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagagcctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 138 - DNA, 822 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatggg

SEQ ID NO: 139 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagattgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 140 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgtgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 141 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagctgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 142 - DNA, 546 bp, Homo sapiens
gctcccactccatgagctatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccctccagatgatgtttggctgcgacgtggggtcggacgggcgcttcctccgcgggtaccaccagtacgcctacgacggcaaggattacatcgccctgaaagaggacctgcgctcttggaccgcggcggacatggcggctcagatcaccaagcgcaagtgggaggcggcccatgtggcggagcagcagagagcctacctggagggcacgtgcgtggacgggctccgcagatacctggagaacgggaaggagacgctgcagcgcacgg

SEQ ID NO: 143 - DNA, 898 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagagagcctgcggatcgcgctccgctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggabgaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 144 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagagagcctgcggatcgcgctccgctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 145 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagagagcctgcggatcgcgctccgctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacgg

SEQ ID NO: 146 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagagagcctgcggatcgcgctccgctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagcagagagcctacctggagggccggtgcgtggagtggctccgcagatacctggagaacgggaaggagacgctgcagcgcacgg

SEQ ID NO: 147 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 148 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcagaacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 149 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactcaccgagtggacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 150 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggcctgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 151 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagagaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 152 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactcaccgagtggacctggggaccctgcgcggctactacaaccagagcgaggacggttctcacaccatccagaggatgtatggctgcgacgtggggccggacgggcgcttcctccgcgggtaccagcgggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacgg

SEQ ID NO: 153 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacggggagacacggaaagtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 154 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagcagagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 155 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggcacgtgcgtggagtggctccgcagatacctggagaacgggaaggagacgctgcagcgcacgg

SEQ ID NO: 156 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaaagaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacgg

SEQ ID NO: 157 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgtggcggagcagtggagagcctacctggagggccggtgcgtggagtggctccgcagatacctggagaacgggaaggagacgctgcagcgcacgg

SEQ ID NO: 158 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacgg

SEQ ID NO: 159 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggaggcggcccatgaggcggagcagtggagagcctacctggagggccggtgcgtggagtggctccgcagatacctggagaacgggaaggagacgctgcagcgcacgg

SEQ ID NO: 160 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttggacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 161 - DNA, 546 bp, Homo sapiens
gctcccactccatgaggtatttctccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacgg

SEQ ID NO: 162 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggtactcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacgg

SEQ ID NO: 163 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggaggcggcccgtgtggcggagcagtggagagcctacctggagggccggtgcgtggagtggctccgcagatacctggagaacgggaaggagacgctgcagcgcacgg

SEQ ID NO: 164 - DNA, 897 bp, Homo sapiens
atggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgccacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggag

SEQ ID NO: 165 - DNA, 897 bp, Homo sapiens
atggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggag

SEQ ID NO: 166 - DNA, 897 bp, Homo sapiens
atggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggacgggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggag

SEQ ID NO: 167 - DNA, 546 bp, Homo sapiens
gctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggcatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 168 - DNA, 546 bp, Homo sapiens
gctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccatgaggcggagcagcagagagcctacctggagggcacgtgcgtggagtggctccgcagatacctggagaacgggaaggagacgctgcagcgcacgg

SEQ ID NO: 169 - DNA, 546 bp, Homo sapiens
gctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcgcgg

SEQ ID NO: 170 - DNA, 546 bp, Homo sapiens
gctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccctccagatgatgtttggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 171 - DNA, 897 bp, Homo sapiens
atggccgtcatggcgccccgaaccctcctcctgctactctcgggggccctggccctgacccagacctgggcgggctcccactccatgaggtatttctccacatccgtgtcccggcccggcagtggagagccccgcttcatcgcagtgggctacgtggacgacacgcagttcgtgcggttcgacagcgacgccgcgagccagaggatggagccgcgggcgccgtggatagagcaggagaggcctgagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtatgaacagcacgcctacgacggcaaggattacatcgccctgaacgaggacctgcgctcttggaccgcggcggacatggcggctcagatcacccagcgcaagtgggaggcggcccgttgggcggagcagttgagagcctacctggagggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 172 - DNA, 887 bp, Homo sapiens
atggccgtcatggcgccccgaaccctcctcctgctactctcgggggccctggccctgacccagacctgggcgggctcccactccatgaggtatttctccacatccgtgtcccggcccggcagtggagagccccgcttcatcgcagtgggctacgtggacgacacgcagttcgtgcggttcgacagcgacgccgcgagccagaggatggagccgcgggcgccgtggatagagcaggagaggcctgagtattgggaccaggagacacggaatgtgaaggcccactcacagactgaccgagagaacctggggaccctgcgcggctactacaaccagagcgaggccggttctcacaccatccagataatgtatggctgcgacgtggggtcggacgggcgcttcctccgcgggtatgaacagcacgcaaggattacatcgccctgaacgaggacctgcgctcttggaccgcggcggacatggcggctcagatcacccagcgcaagtgggaggcggcccgtcgggcggagcagttgagagcctacctggagggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 173 - DNA, 767 bp, Homo sapiens
ggctcccactccatgaggtatttctccacatccgtgtcccggcccggcagtggagagccccgcttcatcgcagtgggctacgtggacgacacgcagttcgtgcggttcgacagcgacgccgcgagccagaggatggagccgcgggcgccgtggatagagcaggaggggccggagtattgggaccaggagacacggaatgtgaaggcccactcacagactgaccgagagaacctggggaccctgcgcggctactacaaccagagcgaggccggttctcacaccatccagataatgtatggctgcgacgtggggtcggacgggcgcttcctccgcgggtatgaacagcacgcctacgacggcaaggattacatcgccctgaacgaggacctgcgctcttggaccgcggcggacatggcggctcagatcacccagcgcaagtgggaggcggcccgtcgggcggagcagttgagagcctacctggagggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagag

SEQ ID NO: 174 - DNA, 546 bp, Homo sapiens
gctcccactccatgaggtatttctccacatccgtgtcccggcccggcagtggagagccccgcttcatcgcagtgggctacgtggacgacacgcagttcgtgcggttcgacagcgacgccgcgagccagaggatggagccgcgggcgccgtggatagagcaggagaggcctgagtattgggaccaggagacacggaatgtgaaggcccactcacagactgaccgagagaacctggggaccctgcgcggctactacaaccagagcgaggccggttctcacaccatccagataatgtatggctgcgacgtggggtcggacgggcgcttcctccgcgggtatgaacagcacgcctacgacggcaaggattacatcgccctgaacgaggacctgcgctcttggaccgcggcggacatggcggctcagatcacccagcgcaagtgggaggcggcccatgtggcggagcagtggagagcctacctggagggcacgtgcgtggagtggctccgcagatacctggagaacgggaaggagacgctgcagcgcacgg

SEQ ID NO: 175 - DNA, 546 bp, Homo sapiens
gctcccactccatgaggtatttctccacatccgtgtcccggcccggcagtggagagccccgcttcatcgcagtgggctacgtggacgacgcgcagttcgtgcggttcgacagcgacgccgcgagccagaggatggagccgcgggcgccgtggatagagcaggagaggcctgagtattgggaccaggagacacggaatgtgaaggcccactcacagactgaccgagagaacctggggaccctgcgcggctactacaaccagagcgaggccggttctcacaccatccagataatgtatggctgcgacgtggggtcggacgggcgcttcctccgcgggtatgaacagcacgcctacgacggcaaggattacatcgccctgaacgaggacctgcgctcttggaccgcggcggacatggcggctcagatcacccagcgcaagtgggaggcggcccatgtggcggagcagtggagagcctacctggagggcacgtgcgtggagtggctccgcagatacctggagaacgggaaggagacgctgcagcgcacgg

SEQ ID NO: 176 - DNA, 546 bp, Homo sapiens
gctcccactccatgaggtatttctccacatccgtgtcccggcccggcagtggagagccccgcttcatcgcagtgggctacgtggacgacacgcagttcgtgcggttcgacagcgacgccgcgagccagaggatggagccgcgggcgccgtggatagagcaggagaggcctgagtattgggacgaggagacagggaaagtgaaggcccactcacagactgaccgagagaacctggggaccctgcgcggctactacaaccagagcgaggccggttctcacaccatccagataatgtatggctgcgacgtggggtcggacgggcgcttcctccgcgggtatgaacagcacgcctacgacggcaaggattacatcgccctgaacgaggacctgcgctcttggaccgcggcggacatggcggctcagatcacccagcgcaagtgggaggcggcccgtcgggcggagcagttgagagcctacctggagggcacgtgcgtggagtggctccgcagatacctggagaacgggaaggagacgctgcagcgcacgg

SEQ ID NO: 177 - DNA, 897 bp, Homo sapiens
atggccgtcatggcgccccgaaccctcctcctgctactctcgggggccctggccctgacccagacctgggcgggctctcactccatgaggtatttctacacctccgtgtcccggcccggcagtggagagccccgcttcatcgcagtgggctacgtggacgacacgcagttcgtgcggttcgacagcgacgccgcgagccagaggatggagccgcgggcgccgtggatagagcaggagaggcctgagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtatgaacagcacgcctacgacggcaaggattacatcgccctgaacgaggacctgcgctcttggaccgcggcggacatggcggctcagatcacccagcgcaagtgggaggcggcccgttgggcggagcagttgagagcctacctggagggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 178 - DNA, 546 bp, Homo sapiens
gctcccactccatgaggtatttctccacatccgtgtcccggcccggcagtggagagccccgcttcatcgcagtgggctacgtggacgacacgcagttcgtgcggttcgacagcgacgccgcgagccagaggatggagccgcgggcgccgtggatagagcaggagaggcctgagtattgggaccaggagacacggaatgtgaaggcccactcacagactgaccgagagaacctggggaccctgcgcggctactacaaccagagcgaggccggttctcacaccatccagataatgtatggctgcgacgtggggtcggacgggcgcttcctccgcgggtatgaacagcacgcctacgacggcaaggattacatcgccctgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 179 - DNA, 822 bp, Homo sapiens
gctcccactccatgaggtatttctccacatccgtgtcccggcccggcagtggagagccccgcttcatcgcagtgggctacgtggacgacacgcagttcgtgcggttcgacagcgacgccgcgagccagaggatggagccgcgggcgccgtggatagagcaggagaggcctgagtattgggaccaggagacacggaatgtgaaggcccactcacagactgaccgagagaacctggggaccctgcgcggctactacaaccagagcgaggccggttctcacaccatccagataatgcatggctgcgacgtggggtcggacgggcgcttcctccgcgggtatgaacagcacgcctacgacggcaaggattacatcgccctgaacgaggacctgcgctcttggaccgcggcggacatggcggctcagatcacccagcgcaagtgggaggcggcccgtcgggcggagcagttgagagcctacctggagggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatggg

SEQ ID NO: 180 - DNA, 546 bp, Homo sapiens
gctcccactccatgaggtatttctccacatccgtgtcccggcccggcagtggagagccccgcttcatcgcagtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggccggttctcacaccatccagataatgtatggctgcgacgtggggtcggacgggcgcttcctccgcgggtatgaacagcacgcctacgacggcaaggattacatcgccctgaacgaggacctgcgctcttggaccgcggcggacatggcggctcagatcacccagcgcaagtgggaggcggcccgttgggcggagcagttgagagcctacctggagggcacgtgcgtggagtggctccgcagatacctggagaacgggaaggagacgctgcagcgcacgg

SEQ ID NO: 181 - DNA, 822 bp, Homo sapiens
gctcccactccatgaggtatttctccacatccgtgtcccggcccggccgcggggagccccgcttcatcgcagtgggctacgtggacgacacgcagttcgtgcggttcgacagcgacgccgcgagccagaggatggagccgcgggcgccgtggatagagcaggagaggcctgagtattgggaccaggagacacggaatgtgaaggcccactcacagactgaccgagagaacctggggaccctgcgcggctactacaaccagagcgaggccggttctcacaccatccagataatgtatggctgcgacgtggggtcggacgggcgcttcctccgcgggtatgaacagcacgcctacgacggcaaggattacatcgccctgaacgaggacctgcgctcttggaccgcggcggacatggcggctcagatcacccagcgcaagtgggaggcggcccgtcgggcggagcagttgagagcctacctggagggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatggg

SEQ ID NO: 182 - DNA, 897 bp, Homo sapiens
atggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggagaggcctgagtattgggaccaggagacacggaatgtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacccccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatggaaccttccagaagtgggcgtctgtggtggtgccttctggacaggagcagagatacacctgccatgtgcagcatgagggtctccccaagcccctcaccctgagatgggag

SEQ ID NO: 183 - DNA, 546 bp, Homo sapiens
gctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggagaggcctgagtattgggaccaggagacacggaaagtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 184 - DNA, 546 bp, Homo sapiens
gctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggagaggcctgagtattgggaccaggagacacggaatgtgaaggcccactcacagattgaccgagtggacctggggaccctgcgcggctactacaaccagagcgaggacggttctcacaccatccagataatgtatggctgcgacgtggggtcggacgggcgcttcctccgcgggtaccggcaggacgcttacgacggcaaggattacatcgccctgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 185 - DNA, 897 bp, Homo sapiens
atggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggagaggcctgagtattgggaccaggagacacggaatgtgaaggcccactcacagattgaccgagtggacctggggaccctgcgcggctactacaaccagagcgaggccggttctcacaccatccagataatgtatggctgcgacgtggggtcggacgggcgcttcctccgcgggtaccggcaggacgcttacgacggcaaggattacatcgccctgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacccccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatggaaccttccagaagtgggcgtctgtggtggtgccttctggacaggagcagagatacacctgccatgtgcagcatgagggtctccccaagcccctcaccctgagatgggag

SEQ ID NO: 186 - DNA, 546 bp, Homo sapiens
gctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggagaggcctgagtattgggaccaggagacacggaatgtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggacgggctccgcagatacctggagaacgggaaggagacgctgcagcgcacgg

SEQ ID NO: 187 - DNA, 546 bp, Homo sapiens
gctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggagaggcctgagtattgggaccaggagacacggaatgtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 188 - DNA, 546 bp, Homo sapiens
gctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggagaggcctgagtattgggaccaggagacacggaaagtgaaggcccactcacagactgaccgagagaacctgcggatcgcgctccgctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 189 - DNA, 546 bp, Homo sapiens
gctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacagggaaagtgaaggcccactcacagactgaccgagagaacctgcggatcgcgctccgctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 190 - DNA, 546 bp, Homo sapiens
gctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggagaggcctgagtattgggaccaggagacacggaatgtgaagggccactcacagattgaccgagtggacctggggaccctgcgcggctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 191 - DNA, 897 bp, Homo sapiens
atggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggag

SEQ ID NO: 192 - DNA, 897 bp, Homo sapiens
atggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccatgtggcggagcagcagagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggag

SEQ ID NO: 193 - DNA, 546 bp, Homo sapiens
gctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagaacctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 194 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatggcacgtgcgtggagtggctccgcagatacctggagaacgggaaggagacgctgcagcgcacgg

SEQ ID NO: 195 - DNA, 897 bp, Homo sapiens
atggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacagggaaagtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggag

SEQ ID NO: 196 - DNA, 546 bp, Homo sapiens
gctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccatgtggcggagcagttgagagcctacctggagggcacgtgcgtggagtggctccgcagatacctggagaacgggaaggagacgctgcagcgcacgg

SEQ ID NO: 197 - DNA, 546 bp, Homo sapiens
gctcccactccatgaggtatttctccacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagagagcctgcggatcgcgctccgctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 198 - DNA, 897 bp, Homo sapiens
atggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagacacctggagaacgggaaggagacgctgcagcgcacggacccccccaggacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatggaaccttccagaagtgggcgtctgtggtggtgccttctggacaggagcagagatacacctgccatgtgcagcatgagggtctccccaagcccctcaccctgagatgggag

SEQ ID NO: 199 - DNA, 897 bp, Homo sapiens
atggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacccccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatggaaccttccagaagtgggcgtctgtggtggtgccttctggacaggagcagagatacacctgccatgtgcagcatgagggtctccccaagcccctcaccctgagatgggag

SEQ ID NO: 200 - DNA, 546 bp, Homo sapiens
gctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgagctcctggaccgcggcggacatggcggctcagatcacccagcgcaagtgggaggcggcccgtgtggcggagcagttgagagcctacctggagggcacgtgcgtggagtggctccgcagacacctggagaacgggaaggagacgctgcagcgcacgg

SEQ ID NO: 201 - DNA, 546 bp, Homo sapiens
gctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatagagcgggaggggccggagtattgggaccggaacacacggaatgtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagacacctggagaacgggaaggagacgctgcagcgcacgg

SEQ ID NO: 202 - DNA, 739 bp, Homo sapiens
gctcccactccatgaggtatttcaccacatccgtgtcccggcccggccgcggggagccccgcttcatcgccgtgggctacgtggacgacacgcagttcgtgcggttcgacagcgacgccgcgagccagaggatggagccgcgggcgccgtggatggagcaggaggggccggagtattgggaccggaacacacggaatgtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacccccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatggaaccttccagaagtgggcgtctgt

SEQ ID NO: 203 - DNA, 897 bp, Homo sapiens
atggccatcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaaagtgaaggcccagtcacagactgaccgagtggacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggcacgtgcgtggagtggctccgcagatacctggagaacgggaaggagacgctgcagcgcacggacgcccccaagacacatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatggaaccttccagaagtgggcgtctgtggtggtgccttctggacaggagcagagatacacctgccatgtgcagcatgagggtctgcccaagcccctcaccctgagatgggag

SEQ ID NO: 204 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggacggttctcacaccatccagataatgtatggctgcgacgtggggtcggacgggcgcttcctccgcgggtaccggcaggacgcttacgacggcaaggattacatcgccctgaacgaggacctgcgctcttggaccgcggcggacatggcggctcagatcacccagcgcaagtgggagacggcccatgaggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatggaaccttccagaagtgggcgtctgtggtggtgccttctggacaggagcagagatacacctgccatgtgcagcatgagggtctgcccaagcccctcaccctgagatgggag

SEQ ID NO: 205 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggacggttctcacaccatccagataatgtatggctgcgacgtggggtcggacgggcgcttcctccgcgggtaccggcaggacgcttacgacggcaaggattacatcgccctgaacgaggacctgcgctcttggaccgcggcggacatggcggctcagatcacccagcgcaagtgggaggcggcccatgaggcggagcagttgagagcctacctggagggcacgtgcgtggagtggctccgcagatacctggagaacgggaaggagacgctgcagcgcacgg

SEQ ID NO: 206 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggagaggccggagtattgggaccggaacacacggaatgtgaaggcccagtcacagactgaccgagtggacctggggaccctgcgcggctactacaaccagagcgaggacggttctcacaccatccagataatgtatggctgcgacgtggggtcggacgggcgcttcctccgcgggtaccggcaggacgcttacgacggcaaggattacatcgccctgaacgaggacctgcgctcttggaccgcggcggacatggcggctcagatcacccagcgcaagtgggagacggcccatgaggcggagcagttgagagcctacctggagggcacgtgcgtggagtggctccgcagatacctggagaacgggaaggagacgctgcagcgcacgg

SEQ ID NO: 207 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaaagtgaaggcccagtcacagactgaccgagtggacctggggaccctgcgcggctactacaaccagagcgaggacggttctcacaccatccagaggatgtatggctgcgacgtggggccggacgggcgcttcctccgcgggtaccagcaggacgcttacgacggcaaggattacatctccctgaacgaggacctgcgctcttggaccgcggcggacatggcggctcagatcacccagcgcaagtgggagacggcccatgaggcggagcagtggagagcctacctggagggcacgtgcgtggagtggctccgcagatacctggagaacgggaaggagacgctgcagcgcacgg

SEQ ID NO: 208 - DNA, 897 bp, Homo sapiens
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 209 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagcctacctggatggcacgtgcgtggagtggctccgcagatacctggagaacgggaaggagacgctgcagcgcacgg

SEQ ID NO: 210 - DNA, 897 bp, Homo sapiens
atggccgtcatggcgccccgaaccctcctcctgctactctcgggggccctggccctgacccagacctgggcgggctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccctccagatgatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggcacgtgcgtggagtggctccgcagatacctggagaacgggaaggagacgctgcagcgcacggacccccccaagacacatatgacccaccaccccatctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggagaggagcagagatacacctgccatgtgcagcatgagggtctgcccaagcccctcaccctgagatgggag

SEQ ID NO: 211 - DNA, 546 bp, Homo sapiens
gctcccactccatgaggtatttcttcacatccgtgtcccggcccggccgcggggagccccgcttcatcgccgtgggctacgtggacgacacgcagttcgtgcggttcgacagcgacgccgcgagccagaagatggagccgcgggcgccgtggatagagcaggaggggccggagtattgggaccaggagacacggaatatgaaggcccactcacagactgaccgagcgaacctggggaccctgcgcggctactacaaccagagcgaggacggttctcacaccatccagataatgtatggctgcgacgtggggccggacgggcgcttcctccgcgggtaccggcaggacgcctacgacggcaaggattacatcgccctgaacgaggacctgcgctcttggaccgcggcggacatggcagctcagatcaccaagcgcaagtgggaggcggtccatgcggcggagcagcggagagtctacctggagggccggtgcgtggagtggctccgcagatacctggagaacgggaaggagacgctgcagcgcacgg

SEQ ID NO: 212 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacctgcagacacggaatgtgaaggcccactcacagactgaccgagcgaacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 213 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatgggag

SEQ ID NO: 214 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggcgagtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatggaaccttccagaagtgggcgtctgtggtggtgccttctggacaggagcagagatacacctgccatgtgcagcatgagggtctgcccaagcccctcaccctgagatgggag

SEQ ID NO: 215 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagtggacctggggaccctgcgcggctactacaaccagagcgaggccggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggcgagtgcgtggagtggctccgcagatacctggagaacgggaaggagacgctgcagcgcacgg

SEQ ID NO: 216 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggacggttctcacaccatccagaggatgtatggctgcgacgtggggccggacgggcgcttcctccgcgggtaccagcaggacgcttacgacggcaaggattacatcgccctgaacgaggacctgcgctcttggaccgcggcggacatggcggctcagatcacccagcgcaagtgggagacggcccatgaggcggagcagtggagagcctacctggagggccggtgcgtggagtggctccgcagacacctggagaacgggaaggagacgctgcagcgcacgg

SEQ ID NO: 217 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggtggctgtggtggtgccttctggacaggagcagagatacacctgccatgtgcagcatgagggtttgcccaagcccctcaccctgagatgggag

SEQ ID NO: 218 - DNA, 897 bp, Homo sapiens
atggccgtcatggcgccccgaaccctcgtcctgctactctcgggggccctggccctgacccagacctgggcgggctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggtggctgtggtggtgccttctggacaggagcagagatacacctgccatgtgcagcatgagggtttgcccaagcccctcaccctgagatgggag

SEQ ID NO: 219 - DNA, 897 bp, Homo sapiens
atggccgtcatggcgccccgaaccctcgtcctgctactctcgggggccctggccctgacccagacctgggcgggctcccactccatgaggtatttctacacctccatgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagaggatgtatggctgcgacgtggggccggacgggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggtggctgtggtggtgccttctggacaggagcagagatacacctgccatgtgcagcatgagggtttgcccaagcccctcaccctgagatgggag

SEQ ID NO: 220 - DNA, 897 bp, Homo sapiens
atggccgtcatggcgccccgaaccctcgtcctgctactctcgggggccctggccctgacccagacctgggcgggctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggtggctgtggtggtgccttctggacaggagcagagatacacctgccatgtgcagcatgagggtttgcccaagcccctcaccctgagatgggag

SEQ ID NO: 221 - DNA, 546 bp, Homo sapiens
gctctcactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgg

SEQ ID NO: 222 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagattgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgg

SEQ ID NO: 223 - DNA, 546 bp, Homo sapiens
gctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactcaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgg

SEQ ID NO: 224 - DNA, 546 bp, Homo sapiens
gctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtatgaacagcacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgg

SEQ ID NO: 225 - DNA, 546 bp, Homo sapiens
gctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcagcacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgg

SEQ ID NO: 226 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagctgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggtggctgtggtggtgccttctggacaggagcagagatacacctgccatgtgcagcatgagggtttgcccaagcccctcaccctgagatgggag

SEQ ID NO: 227 - DNA, 546 bp, Homo sapiens
gctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagcagagagcctacctggagggcacgtgcgtggagtggctccgcagatacctggagaacgggaaggagacgctgcagcgcacgg

SEQ ID NO: 228 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgg

SEQ ID NO: 229 - DNA, 579 bp, Homo sapiens
accctcgtcctgctactctcgggggccctggccctgacccagacctgggcgggctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagatcaccaagcacaagtgggaggcggcccatgtggcggagcagtggagagcctacctggagggcacgtgcgtggagtggctccgcagatacctggagaacgggaag

SEQ ID NO: 230 - DNA, 866 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccgggagacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggtggctgtggtggtgccttctggacaggagcagagatacacctgccatgtgcagcatgaggg

SEQ ID NO: 231 - DNA, 546 bp, Homo sapiens
gctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggacgaggagacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcgcgg

SEQ ID NO: 232 - DNA, 546 bp, Homo sapiens
gctcccactccatgaggtatttctacacctccatgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactcaccgagtggacctggggaccctgcgcggctactacaaccagagcgaggccggttctcacaccatccagaggatgtatggctgcgacgtggggccggacgggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgg

SEQ ID NO: 233 - DNA, 615 bp, Homo sapiens
ccgtcatggcgccccgaaccctcgtcctgctactctcgggggccctggccctgacccagacctgggcgggctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccttgtggcggagcagtggagagcctacctggagggcacgtgcgtggagtggctccgcagatacctggagaacgggaaggagacgctgcagcgcacgg

SEQ ID NO: 234 - DNA, 897 bp, Homo sapiens
atggccgtcatggcgccccgaaccctcgtcctgctactctcgggggccctggccctgacccagacctgggcgggctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggtcgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggtggctgtggtggtgccttctggacaggagcagagatacacctgccatgtgcagcatgagggtttgcccaagcccctcaccctgagatgggag

SEQ ID NO: 235 - DNA, 546 bp, Homo sapiens
gctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggatggcacgtgcgtggagtggctccgcagatacctggagaacgggaaggagacgctgcagcgcacgg

SEQ ID NO: 236 - DNA, 546 bp, Homo sapiens
gctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccactcacagactcaccgagtggacctggggaccctgcgcggctactacaaccagagcgaggccggttctcacaccatccagatgatgtatggctgcgacgtggggtcggacgggcacttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgg

SEQ ID NO: 237 - DNA, 546 bp, Homo sapiens
gctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaaccggaaggagacgctgcagcgcacgg

SEQ ID NO: 238 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcacggctactacaaccagagcgaggccggttctcacaccatccagatgatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggtggctgtggtggtgccttctggacaggagcagagatacacctgccatgtgcagcatgagggtttgcccaagcccctcaccctgagatgggag

SEQ ID NO: 239 - DNA, 546 bp, Homo sapiens
gctcccactccatgaggtatttctacacttccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccatccagaggatgtatggctgcgacgtggggtcggacgggcgcttcctccgcgggtaccggcaggacgcctacgacggcaaggattacatcgccctgaaagaggacctgcgctcttggaccgcggcggacatggcagctcagaccaccaagcacaagtgggaggcggcccatgtggcggagcagtggagagcctacctggagggcacgtgcgtggagtggctccgcagatacctggagaacgggaaggagacgctgcagcgcacgg

SEQ ID NO: 240 - DNA, 897 bp, Homo sapiens
atggccgtcatggcgccccgaaccctcgtcctgctactctcgggggccctggccctgacccagacctgggcgggctcccactccatgaggtatttctacacctccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccggaacacacggaatgtgaaggcccagtcacagactgaccgagtggacctggggaccctgcgcggctactacaaccagagcgaggccggttctcacaccgtccagaggatgtatggctgcgacgtggggtcggactggcgcttcctccgcgggtaccaccagtacgcctacgacggcaaggattacatcgccctgaaagaggacctgcgctcttggaccgcggcggacatggcagctcagaccaccaagcacaagtgggaggcggcccatgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggag

SEQ ID NO: 241 - DNA, 897 bp, Homo sapiens
atggccgtcatggcgccccgaaccctcctcctgctactcttgggggccctggccctgacccagaccagggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagtggacctggggaccctgcgcggctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaagacgcatatgactcaccacgctgtctctgaccatgaggccaccctgaggtgctgggccctgagcttctaccctgcggagatcacactgacctggcagcgggatggggaggaccagacccaggacacggagcttgtggagaccaggcctgcaggggatggaaccttccagaagtgggcgtctgtggtggtgccttctggacaggagcagagatacacctgccatgtgcagcatgagggtctgcccaagcccctcaccctgagatgggag

SEQ ID NO: 242 - DNA, 619 bp, Homo sapiens
atggccgtcatggcgccccgaaccctcctcctgctactcttgggggccctggccctgacccagacctgggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagtggacctggggaccctgcgcggctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 243 - DNA, 619 bp, Homo sapiens
atggccgtcatggcgccccgaaccctcctcctgctactcttgggggccctggccctgacccagaccagggcgggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagtggacctggcgaccctgcgcggctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 244 - DNA, 547 bp, Homo sapiens
ggctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggagggtccggagtattgggacggggagacacggaaagtgaaggcccactcacagactgaccgagtggacctggggaccctgcgcggctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 245 - DNA, 546 bp, Homo sapiens
gctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacaggctgaccgagtggacctggggaccctgcgcggctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 246 - DNA, 545 bp, Homo sapiens
gctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactcaccgagtggacctggggaccctgcgcggctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacg

SEQ ID NO: 247 - DNA, 546 bp, Homo sapiens
gctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagattgaccgagtggacctggggaccctgcgcggctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 248 - DNA, 546 bp, Homo sapiens
gctcccactccatgaggtatttcttcacatccgtgtcccggcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagtggacctggggaccctgcgcggctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggccagtgtggcggagcagttgagagcctacctggagggcacgtgcgtggagtggctccgcagatacctggagaacgggaaggagacgctgcagcgcacgg

SEQ ID NO: 249 - DNA, 546 bp, Homo sapiens
gctcccactccatgaggtatttcttcacatccgtgtccccgcccggccgcggggagccccgcttcatcgccgtgggctacgtggacgacacgcagttcgtgcggtttgacagcgacgccgcgagccagaggatggagccgcgggcgccgtggatagagcaggaggggccggagtattgggaccaggagacacggaatgtgaaggcccactcacagactgaccgagtggacctggggaccctgcgcggctactacaaccagagcgaggccggttctcacaccatccagatgatgtatggctgcgacgtggggccggacgggcgcctcctccgcgggtaccagcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacgg

SEQ ID NO: 250 - DNA, 897 bp, Homo sapiens
atggccgtcatgccgccccgaaccctcctcctgctactctcgggggccctggccctgacccagacctgggcaggctcccactccatgaggtatttcttcacatccgtgtcccggcccggccgcggggagccccgcttcatcgcagtgggctacgtggacgactcgcagttcgtgcagttcgacagcgacgccgcgagccagaggatggagccgcgggcgccgtggatagagcaggaggagccggagtattgggacgaggagacacggaatgtgaaggcccactcacagactaaccgagcgaacctggggaccctgcgcggctactacaaccagagcgaggacggttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccgtcgggcggagcagctgagagcctacctggagggcgagtgcgtggacgggctccgcagatacctggagaacgggaaggagacgctgcagcgcacggacccccccaagacacatatgacccaccaccccatctctgaccatgaggccactctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtaccttctggaaaggagaagagatacacctgccatgtgcagcatgagggtctgcccgagcccctcaccctgagatgggag

SEQ ID NO: 251 - DNA, 16 bp, Homo sapiens
gccccgcttcatcgcc

SEQ ID NO: 252 - DNA, 19 bp, Homo sapiens
gaccaggagacacggaata

SEQ ID NO: 253 - DNA, 17 bp, Homo sapiens
gcggagcagcggagagt

SEQ ID NO: 254 - DNA, 17 bp, Homo sapiens
agtctacctggagggcc

SEQ ID NO: 255 - DNA, 17 bp, Homo sapiens
gtctacctggagggccg

SEQ ID NO: 256 - DNA, 16 bp, Homo sapiens
aggtgctgggccctgg

SEQ ID NO: 257 - DNA, 17 bp, Homo sapiens
ggtggtgccttctggag

SEQ ID NO: 258 - DNA, 18 bp, Homo sapiens
caccctgagatgggagct

SEQ ID NO: 259 - DNA, 17 bp, Homo sapiens
ccctgagatgggagctg

SEQ ID NO: 260 - DNA, 19 bp, Homo sapiens
ggacatggcagctcagatt

SEQ ID NO: 261 - DNA, 20 bp, Homo sapiens
cactccatgaggtatttctc

SEQ ID NO: 262 - DNA, 16 bp, Homo sapiens
ccggcccggcagtgga

SEQ ID NO: 263 - DNA, 19 bp, Homo sapiens
ttctcacaccatccagatg

SEQ ID NO: 264 - DNA, 17 bp, Homo sapiens
ccatgcggcggagcagt

SEQ ID NO: 265 - DNA, 17 bp, Homo sapiens
catgcggcggagcagtt

SEQ ID NO: 266 - DNA, 18 bp, Homo sapiens
atagagcaggagaggcct

SEQ ID NO: 267 - DNA, 18 bp, Homo sapiens
ctcacagactgaccgaga

SEQ ID NO: 268 - DNA, 18 bp, Homo sapiens
ctacaaccagagcgaggc

SEQ ID NO: 269 - DNA, 18 bp, Homo sapiens
gagtctacctggagggct

SEQ ID NO: 270 - DNA, 18 bp, Homo sapiens
gtggacgacacgcagtta

SEQ ID NO: 271 - DNA, 17 bp, Homo sapiens
tgctactctcgggggct

SEQ ID NO: 272 - DNA, 17 bp, Homo sapiens
ggcccactcacagactc

SEQ ID NO: 273 - DNA, 17 bp, Homo sapiens
ggccggttctcacaccg

SEQ ID NO: 274 - DNA, 18 bp, Homo sapiens
ttctcacaccgtccagag

SEQ ID NO: 275 - DNA, 17 bp, Homo sapiens
cgacgtggggtcggact

SEQ ID NO: 276 - DNA, 16 bp, Homo sapiens
gggaggcggcccatgt

SEQ ID NO: 277 - DNA, 18 bp, Homo sapiens
ccatgtggcggagcagtt

SEQ ID NO: 278 - DNA, 17 bp, Homo sapiens
gcctacctggagggcac

SEQ ID NO: 279 - DNA, 17 bp, Homo sapiens
gagctgtggtcgctgct

SEQ ID NO: 280 - DNA, 17 bp, Homo sapiens
agccccgcttcatcgca

SEQ ID NO: 281 - DNA, 17 bp, Homo sapiens
ccggagtattgggacgg

SEQ ID NO: 282 - DNA, 18 bp, Homo sapiens
gacggggagacacggaaa

SEQ ID NO: 283 - DNA, 16 bp, Homo sapiens
cctccgcgggtaccac

SEQ ID NO: 284 - DNA, 17 bp, Homo sapiens
ccgcgggtaccaccagt

SEQ ID NO: 285 - DNA, 19 bp, Homo sapiens
ggattacatcgccctgaaa

SEQ ID NO: 286 - DNA, 18 bp, Homo sapiens
ggacatggcagctcagac

SEQ ID NO: 287 - DNA, 17 bp, Homo sapiens
gggcacgtgcgtggagt

SEQ ID NO: 288 - DNA, 18 bp, Homo sapiens
gcccactcacagactcat

SEQ ID NO: 289 - DNA, 17 bp, Homo sapiens
tgcgctcttggaccgca

SEQ ID NO: 290 - DNA, 20 bp, Homo sapiens
attacatcgccctgaaagaa

SEQ ID NO: 291 - DNA, 16 bp, Homo sapiens
ggggtcggactggcga

SEQ ID NO: 292 - DNA, 15 bp, Homo sapiens
tcccggcccggccgt

SEQ ID NO: 293 - DNA, 19 bp, Homo sapiens
catgtgcagcatgagggtt

SEQ ID NO: 294 - DNA, 18 bp, Homo sapiens
gaccagacccaggacaca

SEQ ID NO: 295 - DNA, 17 bp, Homo sapiens
ccatgtggcggagcagt

SEQ ID NO: 296 - DNA, 17 bp, Homo sapiens
cggactggcgcttcctg

SEQ ID NO: 297 - DNA, 18 bp, Homo sapiens
ccaagcacaagtgggaga

SEQ ID NO: 298 - DNA, 17 bp, Homo sapiens
tgggagacggcccatga

SEQ ID NO: 299 - DNA, 17 bp, Homo sapiens
ccatgaggcggagcagt

SEQ ID NO: 300 - DNA, 20 bp, Homo sapiens
ccatgaggtatttctacacc

SEQ ID NO: 301 - DNA, 18 bp, Homo sapiens
caccgtccagaggatgtg

SEQ ID NO: 302 - DNA, 17 bp, Homo sapiens
gtggagaccaggcctga

SEQ ID NO: 303 - DNA, 18 bp, Homo sapiens
caccgtccagaggatgtt

SEQ ID NO: 304 - DNA, 18 bp, Homo sapiens
gaaggcccactcacagat

SEQ ID NO: 305 - DNA, 17 bp, Homo sapiens
catgtggcggagcagca

SEQ ID NO: 306 - DNA, 16 bp, Homo sapiens
gggaggcggcccatga

SEQ ID NO: 307 - DNA, 17 bp, Homo sapiens
catgaggcggagcagca

SEQ ID NO: 308 - DNA, 17 bp, Homo sapiens
gcctacctggagggcga

SEQ ID NO: 309 - DNA, 19 bp, Homo sapiens
acaccctccagatgatgtt

SEQ ID NO: 310 - DNA, 17 bp, Homo sapiens
gaggtgctgggccctga

SEQ ID NO: 311 - DNA, 16 bp, Homo sapiens
ggaccgcggcggacaa

SEQ ID NO: 312 - DNA, 18 bp, Homo sapiens
cacagactcaccgagtgg

SEQ ID NO: 313 - DNA, 16 bp, Homo sapiens
cgcggcggacatggcg

SEQ ID NO: 314 - DNA, 18 bp, Homo sapiens
gtccggagtattgggacg

SEQ ID NO: 315 - DNA, 17 bp, Homo sapiens
acggggagacacggaac

SEQ ID NO: 316 - DNA, 18 bp, Homo sapiens
cagtgggctacgtggaca

SEQ ID NO: 317 - DNA, 17 bp, Homo sapiens
tgggagacggcccatgt

SEQ ID NO: 318 - DNA, 18 bp, Homo sapiens
ccatgaggcggagcagtt

SEQ ID NO: 319 - DNA, 18 bp, Homo sapiens
agctcagaccaccaagca

SEQ ID NO: 320 - DNA, 17 bp, Homo sapiens
catgcggcggagcagca

SEQ ID NO: 321 - DNA, 18 bp, Homo sapiens
cgtggatagagcaggaga

SEQ ID NO: 322 - DNA, 16 bp, Homo sapiens
gacggggagacacggc

SEQ ID NO: 323 - DNA, 16 bp, Homo sapiens
ctgggcgggctctcag

SEQ ID NO: 324 - DNA, 16 bp, Homo sapiens
tcgacagcgacgccgg

SEQ ID NO: 325 - DNA, 18 bp, Homo sapiens
caccgtccagaggatgtc

SEQ ID NO: 326 - DNA, 18 bp, Homo sapiens
cggaaagtgaaggcccag

SEQ ID NO: 327 - DNA, 17 bp, Homo sapiens
ggcccagtcacagactc

SEQ ID NO: 328 - DNA, 18 bp, Homo sapiens
ggctcagatcaccaagca

SEQ ID NO: 329 - DNA, 17 bp, Homo sapiens
gcggagcagttgagagc

SEQ ID NO: 330 - DNA, 16 bp, Homo sapiens
gggcacgtgcgtggag

SEQ ID NO: 331 - DNA, 15 bp, Homo sapiens
gtgggaggcggcccg

SEQ ID NO: 332 - DNA, 16 bp, Homo sapiens
gggaggcggcccgtgt

SEQ ID NO: 333 - DNA, 17 bp, Homo sapiens
ccgcgggtaccagcagt

SEQ ID NO: 334 - DNA, 17 bp, Homo sapiens
ggagccccgcttcatct

SEQ ID NO: 335 - DNA, 18 bp, Homo sapiens
gaccaggagacacggaaa

SEQ ID NO: 336 - DNA, 18 bp, Homo sapiens
attgggacgaggagacag

SEQ ID NO: 337 - DNA, 18 bp, Homo sapiens
gacgaggagacagggaaa

SEQ ID NO: 338 - DNA, 18 bp, Homo sapiens
gaaggcccactcacagag

SEQ ID NO: 339 - DNA, 20 bp, Homo sapiens
gaggtatttcttcacatcca

SEQ ID NO: 340 - DNA, 18 bp, Homo sapiens
ttcctccgcgggtatgaa

SEQ ID NO: 341 - DNA, 18 bp, Homo sapiens
gagtattgggaccggaac

SEQ ID NO: 342 - DNA, 18 bp, Homo sapiens
cggaatgtgaaggcccag

SEQ ID NO: 343 - DNA, 17 bp, Homo sapiens
ggccggttctcacaccc

SEQ ID NO: 344 - DNA, 18 bp, Homo sapiens
ttctcacaccctccagag

SEQ ID NO: 345 - DNA, 15 bp, Homo sapiens
ccggcccggccgcga

SEQ ID NO: 346 - DNA, 17 bp, Homo sapiens
cgcgggtaccaccagtt

SEQ ID NO: 347 - DNA, 18 bp, Homo sapiens
cacagactgaccgagtgg

SEQ ID NO: 348 - DNA, 19 bp, Homo sapiens
gttgagagcctacctggat

SEQ ID NO: 349 - DNA, 17 bp, Homo sapiens
catgaggcggagcagct

SEQ ID NO: 350 - DNA, 18 bp, Homo sapiens
ctgagagcctacctggat

SEQ ID NO: 351 - DNA, 18 bp, Homo sapiens
tggatagagcaggagggt

SEQ ID NO: 352 - DNA, 18 bp, Homo sapiens
cagagagcctacctggat

SEQ ID NO: 353 - DNA, 17 bp, Homo sapiens
ggcctggttctccttgc

SEQ ID NO: 354 - DNA, 18 bp, Homo sapiens
gagagcctacctggatgc

SEQ ID NO: 355 - DNA, 16 bp, Homo sapiens
ggctgcgacgtggggt

SEQ ID NO: 356 - DNA, 16 bp, Homo sapiens
gggccggtgcgtggag

SEQ ID NO: 357 - DNA, 16 bp, Homo sapiens
ggccggtgcgtggagt

SEQ ID NO: 358 - DNA, 17 bp, Homo sapiens
gctcttggaccgcggca

SEQ ID NO: 359 - DNA, 15 bp, Homo sapiens
ggcccggccgcggga

SEQ ID NO: 360 - DNA, 16 bp, Homo sapiens
gggaggcggcccgtga

SEQ ID NO: 361 - DNA, 17 bp, Homo sapiens
cgtgaggcggagcagca

SEQ ID NO: 362 - DNA, 17 bp, Homo sapiens
ggcagctcagatcaccg

SEQ ID NO: 363 - DNA, 16 bp, Homo sapiens
gccggacgggcgctta

SEQ ID NO: 364 - DNA, 17 bp, Homo sapiens
gcagagagcctacctgc

SEQ ID NO: 365 - DNA, 18 bp, Homo sapiens
gccggagtattgggacct

SEQ ID NO: 366 - DNA, 18 bp, Homo sapiens
ggcagctcagatcaccag

SEQ ID NO: 367 - DNA, 15 bp, Homo sapiens
ggaggcggcccgtcg

SEQ ID NO: 368 - DNA, 18 bp, Homo sapiens
acgaggagacagggaaag

SEQ ID NO: 369 - DNA, 16 bp, Homo sapiens
cccagcccaccgtcca

SEQ ID NO: 370 - DNA, 17 bp, Homo sapiens
ccgtgtggcggagcagt

SEQ ID NO: 371 - DNA, 17 bp, Homo sapiens
gcggagcagtggagagc

SEQ ID NO: 372 - DNA, 19 bp, Homo sapiens
ggcaaggattacatcgcct

SEQ ID NO: 373 - DNA, 17 bp, Homo sapiens
cgtgtggcggagcagtt

SEQ ID NO: 374 - DNA, 18 bp, Homo sapiens
ctcccactccatgaggtg

SEQ ID NO: 375 - DNA, 18 bp, Homo sapiens
cgctccgctactacaacg

SEQ ID NO: 376 - DNA, 16 bp, Homo sapiens
ctgcggatcgcgctcc

SEQ ID NO: 377 - DNA, 17 bp, Homo sapiens
gcggagcagcagagagc

SEQ ID NO: 378 - DNA, 17 bp, Homo sapiens
atcttcccagcccaccg

SEQ ID NO: 379 - DNA, 18 bp, Homo sapiens
ctgggcttctaccctgca

SEQ ID NO: 380 - DNA, 18 bp, Homo sapiens
cgcgggtaccaccagtat

SEQ ID NO: 381 - DNA, 17 bp, Homo sapiens
agacgctgcagcgcact

SEQ ID NO: 382 - DNA, 17 bp, Homo sapiens
ggcggctcagatcaccc

SEQ ID NO: 383 - DNA, 18 bp, Homo sapiens
gggaaagtgaaggcccag

SEQ ID NO: 384 - DNA, 17 bp, Homo sapiens
cctgggcaggctcccaa

SEQ ID NO: 385 - DNA, 17 bp, Homo sapiens
gggcacgtgcgtggact

SEQ ID NO: 386 - DNA, 17 bp, Homo sapiens
gacgggcgcttcctcca

SEQ ID NO: 387 - DNA, 16 bp, Homo sapiens
ggaccgcggcggacag

SEQ ID NO: 388 - DNA, 18 bp, Homo sapiens
cggagtattgggacgagc

SEQ ID NO: 389 - DNA, 18 bp, Homo sapiens
acagactgaccgagagag

SEQ ID NO: 390 - DNA, 17 bp, Homo sapiens
ccagaggatggagccgt

SEQ ID NO: 391 - DNA, 18 bp, Homo sapiens
gagccagaggatggagct

SEQ ID NO: 392 - DNA, 17 bp, Homo sapiens
gctcccactccatgagc

SEQ ID NO: 393 - DNA, 16 bp, Homo sapiens
gcctgcaggggatggg

SEQ ID NO: 394 - DNA, 17 bp, Homo sapiens
ccagcgcaagtgggaga

SEQ ID NO: 395 - DNA, 17 bp, Homo sapiens
ccgcgggtaccagcaga

SEQ ID NO: 396 - DNA, 17 bp, Homo sapiens
gcctacctggagggcct

SEQ ID NO: 397 - DNA, 16 bp, Homo sapiens
tccgcgggtaccagcg

SEQ ID NO: 398 - DNA, 17 bp, Homo sapiens
ttcctccgcgggtacca

SEQ ID NO: 399 - DNA, 17 bp, Homo sapiens
ggtaccagcaggacgct

SEQ ID NO: 400 - DNA, 17 bp, Homo sapiens
cgcagttcgtgcggttg

SEQ ID NO: 401 - DNA, 17 bp, Homo sapiens
ccagagcgaggacggta

SEQ ID NO: 402 - DNA, 19 bp, Homo sapiens
cagatgatgtatggctgcc

SEQ ID NO: 403 - DNA, 16 bp, Homo sapiens
gatggagccgcgggca

SEQ ID NO: 404 - DNA, 17 bp, Homo sapiens
ggacctgcagacacggc

SEQ ID NO: 405 - DNA, 16 bp, Homo sapiens
gagacgctgcagcgcg

SEQ ID NO: 406 - DNA, 16 bp, Homo sapiens
tgggaggcggcccgtt

SEQ ID NO: 407 - DNA, 15 bp, Homo sapiens
gggaggcggcccgtc

SEQ ID NO: 408 - DNA, 17 bp, Homo sapiens
gggctacgtggacgacg

SEQ ID NO: 409 - DNA, 19 bp, Homo sapiens
cacaccatccagataatgc

SEQ ID NO: 410 - DNA, 18 bp, Homo sapiens
gtgcagcatgagggtctc

SEQ ID NO: 411 - DNA, 17 bp, Homo sapiens
ggtaccggcaggacgct

SEQ ID NO: 412 - DNA, 20 bp, Homo sapiens
ccactccatgaggtatttca

SEQ ID NO: 413 - DNA, 18 bp, Homo sapiens
gacacggaatgtgaaggg

SEQ ID NO: 414 - DNA, 20 bp, Homo sapiens
cctagttctctttggagcta

SEQ ID NO: 415 - DNA, 15 bp, Homo sapiens
ggccggacgggcgcc

SEQ ID NO: 416 - DNA, 17 bp, Homo sapiens
gcctacctggatggcac

SEQ ID NO: 417 - DNA, 17 bp, Homo sapiens
tggcacgtgcgtggagt

SEQ ID NO: 418 - DNA, 18 bp, Homo sapiens
gaccaggagacagggaaa

SEQ ID NO: 419 - DNA, 16 bp, Homo sapiens
gcacggacccccccag

SEQ ID NO: 420 - DNA, 17 bp, Homo sapiens
acgaggacctgagctcc

SEQ ID NO: 421 - DNA, 17 bp, Homo sapiens
gcgccgtggatagagcg

SEQ ID NO: 422 - DNA, 16 bp, Homo sapiens
gcgggcgccgtggatg

SEQ ID NO: 423 - DNA, 17 bp, Homo sapiens
ccccatcgtgggcatcc

SEQ ID NO: 424 - DNA, 16 bp, Homo sapiens
ctgcagcgcacggacg

SEQ ID NO: 425 - DNA, 16 bp, Homo sapiens
ggacgcccccaagacg

SEQ ID NO: 426 - DNA, 19 bp, Homo sapiens
ctctttggagctgtgatcg

SEQ ID NO: 427 - DNA, 19 bp, Homo sapiens
gacggcaaggattacatct

SEQ ID NO: 428 - DNA, 17 bp, Homo sapiens
gtctacctggagggcac

SEQ ID NO: 429 - DNA, 18 bp, Homo sapiens
cggagagcctacctggat

SEQ ID NO: 430 - DNA, 17 bp, Homo sapiens
ggacggttctcacaccc

SEQ ID NO: 431 - DNA, 17 bp, Homo sapiens
gggcgagtgcgtggagt

SEQ ID NO: 432 - DNA, 17 bp, Homo sapiens
ggagtggctccgcagac

SEQ ID NO: 433 - DNA, 19 bp, Homo sapiens
gaaccttccagaagtgggt

SEQ ID NO: 434 - DNA, 20 bp, Homo sapiens
ccatgaggtatttctacact

SEQ ID NO: 435 - DNA, 20 bp, Homo sapiens
gaggtatttctacacctcca

SEQ ID NO: 436 - DNA, 16 bp, Homo sapiens
cgcgggtaccggcagc

SEQ ID NO: 437 - DNA, 17 bp, Homo sapiens
catgtggcggagcagct

SEQ ID NO: 438 - DNA, 17 bp, Homo sapiens
gccggagtattgggacg

SEQ ID NO: 439 - DNA, 16 bp, Homo sapiens
agtgggaggcggccct

SEQ ID NO: 440 - DNA, 16 bp, Homo sapiens
gcgggtaccggcaggt

SEQ ID NO: 441 - DNA, 18 bp, Homo sapiens
tggagagcctacctggat

SEQ ID NO: 442 - DNA, 16 bp, Homo sapiens
tggggtcggacgggca

SEQ ID NO: 443 - DNA, 18 bp, Homo sapiens
gcagatacctggagaacc

SEQ ID NO: 444 - DNA, 17 bp, Homo sapiens
gacctggggaccctgca

SEQ ID NO: 445 - DNA, 19 bp, Homo sapiens
gttctcacaccatccagag

SEQ ID NO: 446 - DNA, 17 bp, Homo sapiens
ggccctgacccagacca

SEQ ID NO: 447 - DNA, 18 bp, Homo sapiens
cctcctcctgctactctt

SEQ ID NO: 448 - DNA, 17 bp, Homo sapiens
ctcctccgcgggtacca

SEQ ID NO: 449 - DNA, 17 bp, Homo sapiens
gaccgagtggacctggc

SEQ ID NO: 450 - DNA, 17 bp, Homo sapiens
gaaggcccactcacagg

SEQ ID NO: 451 - DNA, 18 bp, Homo sapiens
cacagattgaccgagtgg

SEQ ID NO: 452 - DNA, 17 bp, Homo sapiens
caagtgggaggcggcca

SEQ ID NO: 453 - DNA, 18 bp, Homo sapiens
cttcacatccgtgtcccc

SEQ ID NO: 454 - DNA, 18 bp, Homo sapiens
cagcccaccatccccatt

SEQ ID NO: 455 - DNA, 18 bp, Homo sapiens
cttcatcgccgtgggcta

SEQ ID NO: 456 - DNA, 19 bp, Homo sapiens
acacggaatatgaaggccc

SEQ ID NO: 457 - DNA, 17 bp, Homo sapiens
gcggagagtctacctgg

SEQ ID NO: 458 - DNA, 16 bp, Homo sapiens
ggagggccggtgcgtg

SEQ ID NO: 459 - DNA, 16 bp, Homo sapiens
ggagggccggtgcgtg

SEQ ID NO: 460 - DNA, 17 bp, Homo sapiens
gggccctgggcttctac

SEQ ID NO: 461 - DNA, 17 bp, Homo sapiens
gtggtggtgccttctgg

SEQ ID NO: 462 - DNA, 18 bp, Homo sapiens
ccttctggagaggagcag

SEQ ID NO: 463 - DNA, 19 bp, Homo sapiens
agctcagattaccaagcgc

SEQ ID NO: 464 - DNA, 19 bp, Homo sapiens
ggtatttctccacatccgt

SEQ ID NO: 465 - DNA, 16 bp, Homo sapiens
ggcagtggagagcccc

SEQ ID NO: 466 - DNA, 19 bp, Homo sapiens
catccagatgatgtatggc

SEQ ID NO: 467 - DNA, 17 bp, Homo sapiens
cggagcagttgagagcc

SEQ ID NO: 468 - DNA, 18 bp, Homo sapiens
cggagcagttgagagcct

SEQ ID NO: 469 - DNA, 18 bp, Homo sapiens
ggagaggcctgagtattg

SEQ ID NO: 470 - DNA, 18 bp, Homo sapiens
ctgaccgagagaacctgg

SEQ ID NO: 471 - DNA, 17 bp, Homo sapiens
gagcgaggccggttctc

SEQ ID NO: 472 - DNA, 16 bp, Homo sapiens
ggagggctggtgcgtg

SEQ ID NO: 473 - DNA, 18 bp, Homo sapiens
cacgcagttagtgcggtt

SEQ ID NO: 474 - DNA, 16 bp, Homo sapiens
tcgggggctctggccc

SEQ ID NO: 475 - DNA, 18 bp, Homo sapiens
gacacggaaagtgaaggc

SEQ ID NO: 476 - DNA, 18 bp, Homo sapiens
tcacagactcaccgagtg

SEQ ID NO: 477 - DNA, 17 bp, Homo sapiens
ctcacaccgtccagagg

SEQ ID NO: 478 - DNA, 18 bp, Homo sapiens
ccgtccagaggatgtatg

SEQ ID NO: 479 - DNA, 17 bp, Homo sapiens
ggtcggactggcgcttc

SEQ ID NO: 480 - DNA, 16 bp, Homo sapiens
ggcccatgtggcggag

SEQ ID NO: 481 - DNA, 16 bp, Homo sapiens
ggagggcacgtgcgtg

SEQ ID NO: 482 - DNA, 18 bp, Homo sapiens
catgagggtttgcccaag

SEQ ID NO: 483 - DNA, 18 bp, Homo sapiens
cttcatcgcagtgggcta

SEQ ID NO: 484 - DNA, 17 bp, Homo sapiens
ttgggacggggagacac

SEQ ID NO: 485 - DNA, 17 bp, Homo sapiens
gggtaccaccagtacgc

SEQ ID NO: 486 - DNA, 18 bp, Homo sapiens
taccaccagtacgcctac

SEQ ID NO: 487 - DNA, 18 bp, Homo sapiens
cgccctgaaagaggacct

SEQ ID NO: 488 - DNA, 18 bp, Homo sapiens
cagctcagaccaccaagc

SEQ ID NO: 489 - DNA, 16 bp, Homo sapiens
cgtggagtggctccgc

SEQ ID NO: 490 - DNA, 19 bp, Homo sapiens
acagactcatcgagtggac

SEQ ID NO: 491 - DNA, 17 bp, Homo sapiens
tggaccgcagcggacat

SEQ ID NO: 492 - DNA, 18 bp, Homo sapiens
cctgaaagaagacctgcg

SEQ ID NO: 493 - DNA, 17 bp, Homo sapiens
gactggcgattcctccg

SEQ ID NO: 494 - DNA, 15 bp, Homo sapiens
cccggccgtggggag

SEQ ID NO: 495 - DNA, 18 bp, Homo sapiens
ccaggacacagagctcgt

SEQ ID NO: 496 - DNA, 16 bp, Homo sapiens
cgcttcctgcgcgggt

SEQ ID NO: 497 - DNA, 17 bp, Homo sapiens
agtgggagacggcccat

SEQ ID NO: 498 - DNA, 16 bp, Homo sapiens
ggcccatgaggcggag

SEQ ID NO: 499 - DNA, 17 bp, Homo sapiens
cggagcagtggagagcc

SEQ ID NO: 500 - DNA, 18 bp, Homo sapiens
tctcacaccgtccagatg

SEQ ID NO: 501 - DNA, 19 bp, Homo sapiens
tttctacacctccgtgtcc

SEQ ID NO: 502 - DNA, 17 bp, Homo sapiens
gaggatgtgtggctgcg

SEQ ID NO: 503 - DNA, 17 bp, Homo sapiens
caggcctgaaggggatg

SEQ ID NO: 504 - DNA, 18 bp, Homo sapiens
ccgtccagaggatgtttg

SEQ ID NO: 505 - DNA, 18 bp, Homo sapiens
agaggatgtttggctgcg

SEQ ID NO: 506 - DNA, 19 bp, Homo sapiens
actcacagattgaccgagt

SEQ ID NO: 507 - DNA, 17 bp, Homo sapiens
ggagcagcagagagcct

SEQ ID NO: 508 - DNA, 16 bp, Homo sapiens
ggagggcgagtgcgtg

SEQ ID NO: 509 - DNA, 17 bp, Homo sapiens
gtcatggctccccgaac

SEQ ID NO: 510 - DNA, 19 bp, Homo sapiens
agatgatgtttggctgcga

SEQ ID NO: 511 - DNA, 17 bp, Homo sapiens
gggccctgagcttctac

SEQ ID NO: 512 - DNA, 17 bp, Homo sapiens
ggcggacaaggcagctc

SEQ ID NO: 513 - DNA, 16 bp, Homo sapiens
ccgagtggacctgggg

SEQ ID NO: 514 - DNA, 18 bp, Homo sapiens
ggacatggcggctcagat

SEQ ID NO: 515 - DNA, 18 bp, Homo sapiens
tattgggacggggagaca

SEQ ID NO: 516 - DNA, 18 bp, Homo sapiens
gacacggaacgtgaaggc

SEQ ID NO: 517 - DNA, 18 bp, Homo sapiens
tacgtggacaacacgcag

SEQ ID NO: 518 - DNA, 18 bp, Homo sapiens
ccaccaagcacaagtggg

SEQ ID NO: 519 - DNA, 17 bp, Homo sapiens
agcaggagagtccggag

SEQ ID NO: 520 - DNA, 18 bp, Homo sapiens
gagacacggcaagtgaag

SEQ ID NO: 521 - DNA, 18 bp, Homo sapiens
gggctctcagtccatgag

SEQ ID NO: 522 - DNA, 16 bp, Homo sapiens
cgacgccgggagccag

SEQ ID NO: 523 - DNA, 17 bp, Homo sapiens
gaggatgtctggctgcg

SEQ ID NO: 524 - DNA, 18 bp, Homo sapiens
gaaggcccagtcacagac

SEQ ID NO: 525 - DNA, 18 bp, Homo sapiens
tcaccaagcacaagtggg

SEQ ID NO: 526 - DNA, 18 bp, Homo sapiens
agttgagagcctacctgg

SEQ ID NO: 527 - DNA, 17 bp, Homo sapiens
tgcgtggagtggctccg

SEQ ID NO: 528 - DNA, 15 bp, Homo sapiens
gcggcccgtgtggcg

SEQ ID NO: 529 - DNA, 16 bp, Homo sapiens
ggcccgtgtggcggag

SEQ ID NO: 530 - DNA, 18 bp, Homo sapiens
taccagcagtacgcctac

SEQ ID NO: 531 - DNA, 18 bp, Homo sapiens
cgcttcatctcagtgggc

SEQ ID NO: 532 - DNA, 18 bp, Homo sapiens
gaggagacagggaaagtg

SEQ ID NO: 533 - DNA, 18 bp, Homo sapiens
gacagggaaagtgaaggc

SEQ ID NO: 534 - DNA, 18 bp, Homo sapiens
actcacagagtcaccgag

SEQ ID NO: 535 - DNA, 18 bp, Homo sapiens
ttcacatccatgtcccgg

SEQ ID NO: 536 - DNA, 18 bp, Homo sapiens
cgggtatgaacagcacgc

SEQ ID NO: 537 - DNA, 18 bp, Homo sapiens
ggaccggaacacacggaa

SEQ ID NO: 538 - DNA, 18 bp, Homo sapiens
tctcacaccctccagatg

SEQ ID NO: 539 - DNA, 17 bp, Homo sapiens
ctcacaccctccagagg

SEQ ID NO: 540 - DNA, 18 bp, Homo sapiens
ccctccagaggatgtatg

SEQ ID NO: 541 - DNA, 15 bp, Homo sapiens
ggccgcgaggagccc

SEQ ID NO: 542 - DNA, 17 bp, Homo sapiens
ccaccagttcgcctacg

SEQ ID NO: 543 - DNA, 18 bp, Homo sapiens
ctacctggatggcacgtg

SEQ ID NO: 544 - DNA, 17 bp, Homo sapiens
ggagcagctgagagcct

SEQ ID NO: 545 - DNA, 17 bp, Homo sapiens
caggagggtccggagta

SEQ ID NO: 546 - DNA, 18 bp, Homo sapiens
ctggagaaccggaaggag

SEQ ID NO: 547 - DNA, 17 bp, Homo sapiens
cctggatgccacgtgcg

SEQ ID NO: 548 - DNA, 16 bp, Homo sapiens
cgtggggtcggacggg

SEQ ID NO: 549 - DNA, 17 bp, Homo sapiens
accgcggcagacatggc

SEQ ID NO: 550 - DNA, 15 bp, Homo sapiens
ccgcgggaagccccg

SEQ ID NO: 551 - DNA, 15 bp, Homo sapiens
gcggcccgtgaggcg

SEQ ID NO: 552 - DNA, 16 bp, Homo sapiens
ggcccgtgaggcggag

SEQ ID NO: 553 - DNA, 18 bp, Homo sapiens
cagatcaccgagcgcaag

SEQ ID NO: 554 - DNA, 16 bp, Homo sapiens
gggcgcttactccgcg

SEQ ID NO: 555 - DNA, 16 bp, Homo sapiens
ctacctgcagggccgg

SEQ ID NO: 556 - DNA, 18 bp, Homo sapiens
attgggacctgcagacac

SEQ ID NO: 557 - DNA, 18 bp, Homo sapiens
agatcaccaggcgcaagt

SEQ ID NO: 558 - DNA, 15 bp, Homo sapiens
gcccgtcgggcggag

SEQ ID NO: 559 - DNA, 18 bp, Homo sapiens
acagggaaagtgaaggcc

SEQ ID NO: 560 - DNA, 18 bp, Homo sapiens
gaagtgggcagctgtggt

SEQ ID NO: 561 - DNA, 17 bp, Homo sapiens
gtggagagcctacctgg

SEQ ID NO: 562 - DNA, 19 bp, Homo sapiens
tacatcgccttgaacgagg

SEQ ID NO: 563 - DNA, 19 bp, Homo sapiens
ccatgaggtgtttctccac

SEQ ID NO: 564 - DNA, 19 bp, Homo sapiens
tactacaacgagagcgagg

SEQ ID NO: 565 - DNA, 17 bp, Homo sapiens
tcgcgctccgctactac

SEQ ID NO: 566 - DNA, 17 bp, Homo sapiens
gcagagagcctacctgg

SEQ ID NO: 567 - DNA, 18 bp, Homo sapiens
ctaccctgcagagatcac

SEQ ID NO: 568 - DNA, 18 bp, Homo sapiens
ccaccagtatgcctacga

SEQ ID NO: 569 - DNA, 18 bp, Homo sapiens
cagatcacccagcgcaag

SEQ ID NO: 570 - DNA, 18 bp, Homo sapiens
aggctcccaatccatgag

SEQ ID NO: 571 - DNA, 18 bp, Homo sapiens
tgtggtggtaccttctgg

SEQ ID NO: 572 - DNA, 17 bp, Homo sapiens
cggagcagtggagagtc

SEQ ID NO: 573 - DNA, 16 bp, Homo sapiens
cgtggactggctccgc

SEQ ID NO: 574 - DNA, 17 bp, Homo sapiens
cttcctccacgggtacc

SEQ ID NO: 575 - DNA, 16 bp, Homo sapiens
ggcggacagggcggct

SEQ ID NO: 576 - DNA, 18 bp, Homo sapiens
tcacagactcaccgagag

SEQ ID NO: 577 - DNA, 17 bp, Homo sapiens
gggacgagcagacaggg

SEQ ID NO: 578 - DNA, 16 bp, Homo sapiens
ccgagagagcctgcgg

SEQ ID NO: 579 - DNA, 19 bp, Homo sapiens
actcacagattgaccgaga

SEQ ID NO: 580 - DNA, 15 bp, Homo sapiens
ggagccgtgggcgcc

SEQ ID NO: 581 - DNA, 16 bp, Homo sapiens
gatggagctgcgggcg

SEQ ID NO: 582 - DNA, 19 bp, Homo sapiens
ctccatgagctatttctcc

SEQ ID NO: 583 - DNA, 17 bp, Homo sapiens
ggggatgggaccttcca

SEQ ID NO: 584 - DNA, 18 bp, Homo sapiens
ccttctggacaggagcag

SEQ ID NO: 585 - DNA, 19 bp, Homo sapiens
taccagcagaacgcttacg

SEQ ID NO: 586 - DNA, 16 bp, Homo sapiens
ggagggcctgtgcgtg

SEQ ID NO: 587 - DNA, 17 bp, Homo sapiens
gtaccagcgggacgctt

SEQ ID NO: 588 - DNA, 17 bp, Homo sapiens
cgggtaccagcaggacg

SEQ ID NO: 589 - DNA, 17 bp, Homo sapiens
caggacgcttacgacgg

SEQ ID NO: 590 - DNA, 17 bp, Homo sapiens
gtgcggttggacagcga

SEQ ID NO: 591 - DNA, 18 bp, Homo sapiens
gaggacggtactcacacc

SEQ ID NO: 592 - DNA, 16 bp, Homo sapiens
tggctgccacgtgggg

SEQ ID NO: 593 - DNA, 15 bp, Homo sapiens
ccgcgggcaccgtgg

SEQ ID NO: 594 - DNA, 18 bp, Homo sapiens
cagacacggcatgtgaag

SEQ ID NO: 595 - DNA, 16 bp, Homo sapiens
ggcccgttgggcggag

SEQ ID NO: 596 - DNA, 15 bp, Homo sapiens
ggcccgtcgggcgga

SEQ ID NO: 597 - DNA, 17 bp, Homo sapiens
tggacgacgcgcagttc

SEQ ID NO: 598 - DNA, 19 bp, Homo sapiens
cagataatgcatggctgcg

SEQ ID NO: 599 - DNA, 17 bp, Homo sapiens
gagggtctccccaagcc

SEQ ID NO: 600 - DNA, 19 bp, Homo sapiens
aggtatttcaccacatccg

SEQ ID NO: 601 - DNA, 18 bp, Homo sapiens
atgtgaagggccactcac

SEQ ID NO: 602 - DNA, 18 bp, Homo sapiens
cacggagcttgtggagac

SEQ ID NO: 603 - DNA, 15 bp, Homo sapiens
cgggcgcctcctccg

SEQ ID NO: 604 - DNA, 17 bp, Homo sapiens
ggatggcacgtgcgtgg

SEQ ID NO: 605 - DNA, 16 bp, Homo sapiens
cccccccaggacgcat

SEQ ID NO: 606 - DNA, 17 bp, Homo sapiens
ctgagctcctggaccgc

SEQ ID NO: 607 - DNA, 17 bp, Homo sapiens
gatagagcgggaggggc

SEQ ID NO: 608 - DNA, 17 bp, Homo sapiens
ccgtggatggagcagga

SEQ ID NO: 609 - DNA, 16 bp, Homo sapiens
cacggacgcccccaag

SEQ ID NO: 610 - DNA, 17 bp, Homo sapiens
agtgggcgtctgtggtg

SEQ ID NO: 611 - DNA, 18 bp, Homo sapiens
ccccaagacgcatatgac

SEQ ID NO: 612 - DNA, 16 bp, Homo sapiens
gcaggagaggccggag

SEQ ID NO: 613 - DNA, 19 bp, Homo sapiens
gattacatctccctgaacg

SEQ ID NO: 614 - DNA, 17 bp, Homo sapiens
tccgcagacacctggag

SEQ ID NO: 615 - DNA, 17 bp, Homo sapiens
gaagtgggtggctgtgg

SEQ ID NO: 616 - DNA, 19 bp, Homo sapiens
tttctacacttccgtgtcc

SEQ ID NO: 617 - DNA, 17 bp, Homo sapiens
acacctccatgtcccgg

SEQ ID NO: 618 - DNA, 16 bp, Homo sapiens
ccggcagcacgcctac

SEQ ID NO: 619 - DNA, 19 bp, Homo sapiens
tattgggacgaggagacac

SEQ ID NO: 620 - DNA, 16 bp, Homo sapiens
ggcggcccttgtggcg

SEQ ID NO: 621 - DNA, 16 bp, Homo sapiens
ccggcaggtcgcctac

SEQ ID NO: 622 - DNA, 17 bp, Homo sapiens
ggacgggcacttcctcc

SEQ ID NO: 623 - DNA, 17 bp, Homo sapiens
gaccctgcacggctact

SEQ ID NO: 624 - DNA, 19 bp, Homo sapiens
ccatccagaggatgtatgg

SEQ ID NO: 625 - DNA, 16 bp, Homo sapiens
ccagaccagggcgggc

SEQ ID NO: 626 - DNA, 17 bp, Homo sapiens
gctactcttgggggccc

SEQ ID NO: 627 - DNA, 16 bp, Homo sapiens
ggacctggcgaccctg

SEQ ID NO: 628 - DNA, 18 bp, Homo sapiens
cactcacaggctgaccga

SEQ ID NO: 629 - DNA, 16 bp, Homo sapiens
ggcggccagtgtggcg

SEQ ID NO: 630 - DNA, 15 bp, Homo sapiens
gtgtccccgcccggc

SEQ ID NO: 631 - DNA, 16 bp, Homo sapiens
tctgcccgagcccctc

SEQ ID NO: 632 - DNA, 21 bp, Homo sapiens
cccatctcagggtgaggggct

SEQ ID NO: 633 - DNA, 20 bp, Homo sapiens
gcgctgcagcgtctccttcc

SEQ ID NO: 634 - DNA, 23 bp, Homo sapiens
gcccaggtctgggtcagggccag

SEQ ID NO: 635 - DNA, 18 bp, Homo sapiens
atggctccccgaaccctc

SEQ ID NO: 636 - DNA, 18 bp, Homo sapiens
atggcgccccgaaccctc

SEQ ID NO: 637 - DNA, 19 bp, Homo sapiens
catctcagggtgaggggct

SEQ ID NO: 638 - DNA, 19 bp, Homo sapiens
aggtatttctacacctccg

SEQ ID NO: 639 - DNA, 17 bp, Homo sapiens
ctcacaccctccagagc

SEQ ID NO: 640 - DNA, 15 bp, Homo sapiens
gcctcctccgcgggc

SEQ ID NO: 641 - DNA, 17 bp, Homo sapiens
ccgcgggcatgaccagt

SEQ ID NO: 642 - DNA, 16 bp, Homo sapiens
gtgaggcggagcagcg

SEQ ID NO: 643 - DNA, 16 bp, Homo sapiens
tgaggcggagcagcgg

SEQ ID NO: 644 - DNA, 17 bp, Homo sapiens
gcctacctggagggcga

SEQ ID NO: 645 - DNA, 17 bp, Homo sapiens
ggcgagtgcgtggagtg

SEQ ID NO: 646 - DNA, 17 bp, Homo sapiens
cgggaaggacaagctgg

SEQ ID NO: 647 - DNA, 16 bp, Homo sapiens
ggagtggctccgcagg

SEQ ID NO: 648 - DNA, 17 bp, Homo sapiens
gctacgtggacgacacg

SEQ ID NO: 649 - DNA, 20 bp, Homo sapiens
acagatctacaagaccaaca

SEQ ID NO: 650 - DNA, 17 bp, Homo sapiens
gtgaggcggagcaggac

SEQ ID NO: 651 - DNA, 17 bp, Homo sapiens
cctcctccgcgggcata

SEQ ID NO: 652 - DNA, 18 bp, Homo sapiens
cgtcttcccagtccacca

SEQ ID NO: 653 - DNA, 17 bp, Homo sapiens
ctcacaccctccagagg

SEQ ID NO: 654 - DNA, 19 bp, Homo sapiens
accggaacacacagatctt

SEQ ID NO: 655 - DNA, 20 bp, Homo sapiens
acagatcttcaagaccaaca

SEQ ID NO: 656 - DNA, 17 bp, Homo sapiens
cgcgggcatgaccagtc

SEQ ID NO: 657 - DNA, 18 bp, Homo sapiens
ccggaacacacagatctg

SEQ ID NO: 658 - DNA, 19 bp, Homo sapiens
cacagactgaccgagagaa

SEQ ID NO: 659 - DNA, 17 bp, Homo sapiens
ggccgggtctcacatca

SEQ ID NO: 660 - DNA, 20 bp, Homo sapiens
acatcatccagaggatgtat

SEQ ID NO: 661 - DNA, 18 bp, Homo sapiens
ggatgtatggctgcgacc

SEQ ID NO: 662 - DNA, 16 bp, Homo sapiens
ctgcgacctggggccc

SEQ ID NO: 663 - DNA, 19 bp, Homo sapiens
agacacagaagtacaagcg

SEQ ID NO: 664 - DNA, 17 bp, Homo sapiens
caagcgccaggcacagg

SEQ ID NO: 665 - DNA, 17 bp, Homo sapiens
gcacaggctgaccgagt

SEQ ID NO: 666 - DNA, 17 bp, Homo sapiens
gaggccgggtctcacat

SEQ ID NO: 667 - DNA, 19 bp, Homo sapiens
gtctcacatcatccagagg

SEQ ID NO: 668 - DNA, 16 bp, Homo sapiens
cgcctcctccgcgggt

SEQ ID NO: 669 - DNA, 17 bp, Homo sapiens
caaggcccaggcacagg

SEQ ID NO: 670 - DNA, 20 bp, Homo sapiens
caagaccaacacacagactt

SEQ ID NO: 671 - DNA, 17 bp, Homo sapiens
cgcgggtatgaccagtc

SEQ ID NO: 672 - DNA, 17 bp, Homo sapiens
gcctacctggagggcac

SEQ ID NO: 673 - DNA, 18 bp, Homo sapiens
ctggagaacgggaaggag

SEQ ID NO: 674 - DNA, 16 bp, Homo sapiens
gacgctggagcgcgcg

SEQ ID NO: 675 - DNA, 17 bp, Homo sapiens
gcctacctggagggcct

SEQ ID NO: 676 - DNA, 17 bp, Homo sapiens
ggcctgtgcgtggagtc

SEQ ID NO: 677 - DNA, 15 bp, Homo sapiens
cggccgcggggagct

SEQ ID NO: 678 - DNA, 16 bp, Homo sapiens
tcctggaccgccgcga

SEQ ID NO: 679 - DNA, 16 bp, Homo sapiens
cggaacctgcgcggcc

SEQ ID NO: 680 - DNA, 16 bp, Homo sapiens
gcctacctggagggcc

SEQ ID NO: 681 - DNA, 16 bp, Homo sapiens
gggaggcggcccgtgt

SEQ ID NO: 682 - DNA, 17 bp, Homo sapiens
gtgtggcggagcaggac

SEQ ID NO: 683 - DNA, 17 bp, Homo sapiens
cgtgaggcggagcagct

SEQ ID NO: 684 - DNA, 18 bp, Homo sapiens
ccggaacacacagatctc

SEQ ID NO: 685 - DNA, 18 bp, Homo sapiens
cacagacttaccgagagg

SEQ ID NO: 686 - DNA, 16 bp, Homo sapiens
ctgcggaccctgctcc

SEQ ID NO: 687 - DNA, 17 bp, Homo sapiens
ccgcgggtatgaccagg

SEQ ID NO: 688 - DNA, 19 bp, Homo sapiens
cactccatgaggtatttcg

SEQ ID NO: 689 - DNA, 18 bp, Homo sapiens
ggtatttcgacaccgcca

SEQ ID NO: 690 - DNA, 16 bp, Homo sapiens
cgagagaggagccgcc

SEQ ID NO: 691 - DNA, 17 bp, Homo sapiens
agcctacctggagggca

SEQ ID NO: 692 - DNA, 19 bp, Homo sapiens
gatgtgtaggaggaagagc

SEQ ID NO: 693 - DNA, 16 bp, Homo sapiens
ctgcgcaccgcgctcc

SEQ ID NO: 694 - DNA, 18 bp, Homo sapiens
ccgagagaacctgcggat

SEQ ID NO: 695 - DNA, 17 bp, Homo sapiens
gagaacctgcggatcgc

SEQ ID NO: 696 - DNA, 16 bp, Homo sapiens
ctgcggatcgcgctcc

SEQ ID NO: 697 - DNA, 16 bp, Homo sapiens
cacgctggagcgcgcg

SEQ ID NO: 698 - DNA, 17 bp, Homo sapiens
ggaccggaacacacaac

SEQ ID NO: 699 - DNA, 19 bp, Homo sapiens
cacttggcagacgatgtat

SEQ ID NO: 700 - DNA, 17 bp, Homo sapiens
ggagtattgggaccggg

SEQ ID NO: 701 - DNA, 18 bp, Homo sapiens
ccgggacacacagatctt

SEQ ID NO: 702 - DNA, 17 bp, Homo sapiens
cgtgtggcggagcagct

SEQ ID NO: 703 - DNA, 16 bp, Homo sapiens
cgcgggtaccaccagg

SEQ ID NO: 704 - DNA, 18 bp, Homo sapiens
cacacagactgaccgagt

SEQ ID NO: 705 - DNA, 19 bp, Homo sapiens
ttcaagaccaacacacagg

SEQ ID NO: 706 - DNA, 18 bp, Homo sapiens
ccgggagacacagatctc

SEQ ID NO: 707 - DNA, 16 bp, Homo sapiens
gtgctgggccctgggc

SEQ ID NO: 708 - DNA, 18 bp, Homo sapiens
ggctcagatcacccagct

SEQ ID NO: 709 - DNA, 18 bp, Homo sapiens
gtctcacacttggcagac

SEQ ID NO: 710 - DNA, 18 bp, Homo sapiens
cgcgggcataaccagtta

SEQ ID NO: 711 - DNA, 18 bp, Homo sapiens
cgatgtatggctgcgacc

SEQ ID NO: 712 - DNA, 18 bp, Homo sapiens
tgggagccatcttcccaa

SEQ ID NO: 713 - DNA, 17 bp, Homo sapiens
gagcagctgagagcctg

SEQ ID NO: 714 - DNA, 17 bp, Homo sapiens
ggtctcacaccctccat

SEQ ID NO: 715 - DNA, 17 bp, Homo sapiens
ccagaccagcaggagac

SEQ ID NO: 716 - DNA, 17 bp, Homo sapiens
ccctgagatgggagcca

SEQ ID NO: 717 - DNA, 20 bp, Homo sapiens
catgaggtatttctacaccg

SEQ ID NO: 718 - DNA, 17 bp, Homo sapiens
ctcccactccatgaggc

SEQ ID NO: 719 - DNA, 16 bp, Homo sapiens
gcaggaggggccggaa

SEQ ID NO: 720 - DNA, 17 bp, Homo sapiens
ggagtggctccgcagac

SEQ ID NO: 721 - DNA, 16 bp, Homo sapiens
gacgctgcagcgcgcg

SEQ ID NO: 722 - DNA, 19 bp, Homo sapiens
caccctccagaggatgtat

SEQ ID NO: 723 - DNA, 17 bp, Homo sapiens
tcctgctgctctcggga

SEQ ID NO: 724 - DNA, 15 bp, Homo sapiens
gcgccccgggcgcca

SEQ ID NO: 725 - DNA, 18 bp, Homo sapiens
gagtattgggaccgggag

SEQ ID NO: 726 - DNA, 17 bp, Homo sapiens
ccgtgaggcggagcagt

SEQ ID NO: 727 - DNA, 18 bp, Homo sapiens
gaccaaactcaggacacc

SEQ ID NO: 728 - DNA, 17 bp, Homo sapiens
ccgcctacgacggcaaa

SEQ ID NO: 729 - DNA, 16 bp, Homo sapiens
gagctcctggaccgcg

SEQ ID NO: 730 - DNA, 19 bp, Homo sapiens
ggattacatcgccctgaat

SEQ ID NO: 731 - DNA, 17 bp, Homo sapiens
cgacacgcagttcgtgc

SEQ ID NO: 732 - DNA, 19 bp, Homo sapiens
cagatctccaagaccaaca

SEQ ID NO: 733 - DNA, 17 bp, Homo sapiens
cggagctgtggtcgcta

SEQ ID NO: 734 - DNA, 18 bp, Homo sapiens
caccctccagaggatgtt

SEQ ID NO: 735 - DNA, 18 bp, Homo sapiens
tacgcctacgacggcaaa

SEQ ID NO: 736 - DNA, 19 bp, Homo sapiens
cagatctgcaagaccaaca

SEQ ID NO: 737 - DNA, 17 bp, Homo sapiens
cgagtccgaggatggct

SEQ ID NO: 738 - DNA, 16 bp, Homo sapiens
gggcctgtgcgtggac

SEQ ID NO: 739 - DNA, 16 bp, Homo sapiens
gggccggctcccactt

SEQ ID NO: 740 - DNA, 17 bp, Homo sapiens
acatgaaggcctccgcg

SEQ ID NO: 741 - DNA, 17 bp, Homo sapiens
gcagctgtggtggtgct

SEQ ID NO: 742 - DNA, 16 bp, Homo sapiens
gtgacccaccaccccg

SEQ ID NO: 743 - DNA, 18 bp, Homo sapiens
gtattgggaccgggagat

SEQ ID NO: 744 - DNA, 17 bp, Homo sapiens
gcgagtccgaggatggc

SEQ ID NO: 745 - DNA, 18 bp, Homo sapiens
caccctccagaggatgtc

SEQ ID NO: 746 - DNA, 16 bp, Homo sapiens
ggaccgccgcggacaa

SEQ ID NO: 747 - DNA, 17 bp, Homo sapiens
gatgtacggctgcgacc

SEQ ID NO: 748 - DNA, 18 bp, Homo sapiens
gtctcacaccctccagac

SEQ ID NO: 749 - DNA, 17 bp, Homo sapiens
ctcacaccctccagacg

SEQ ID NO: 750 - DNA, 17 bp, Homo sapiens
accgagagaacctgcgc

SEQ ID NO: 751 - DNA, 17 bp, Homo sapiens
cgggaaggagacgctgc

SEQ ID NO: 752 - DNA, 18 bp, Homo sapiens
ccctgaacgaggacctga

SEQ ID NO: 753 - DNA, 17 bp, Homo sapiens
ggagccccgcttcatcg

SEQ ID NO: 754 - DNA, 19 bp, Homo sapiens
aggtatttctacaccgcca

SEQ ID NO: 755 - DNA, 16 bp, Homo sapiens
tccgaggatggcgccc

SEQ ID NO: 756 - DNA, 17 bp, Homo sapiens
gttcgacagcgacgcca

SEQ ID NO: 757 - DNA, 15 bp, Homo sapiens
gagccgcgggcgcca

SEQ ID NO: 758 - DNA, 17 bp, Homo sapiens
ggcggagcagctgagaa

SEQ ID NO: 759 - DNA, 17 bp, Homo sapiens
aacctacctggagggcc

SEQ ID NO: 760 - DNA, 17 bp, Homo sapiens
acctacctggagggcct

SEQ ID NO: 761 - DNA, 18 bp, Homo sapiens
ctccaagaccaacacacg

SEQ ID NO: 762 - DNA, 18 bp, Homo sapiens
ctacgtggacgacacgct

SEQ ID NO: 763 - DNA, 18 bp, Homo sapiens
ccgggagacacagatctt

SEQ ID NO: 764 - DNA, 19 bp, Homo sapiens
acacacagacttaccgagt

SEQ ID NO: 765 - DNA, 19 bp, Homo sapiens
cacagacttaccgagtgaa

SEQ ID NO: 766 - DNA, 18 bp, Homo sapiens
ccgcgggcataaccagtt

SEQ ID NO: 767 - DNA, 18 bp, Homo sapiens
cccagttcgtgaggttca

SEQ ID NO: 768 - DNA, 18 bp, Homo sapiens
ccgggagacacagatctg

SEQ ID NO: 769 - DNA, 18 bp, Homo sapiens
ggctcagatcacccagca

SEQ ID NO: 770 - DNA, 17 bp, Homo sapiens
acctacctggagggcac

SEQ ID NO: 771 - DNA, 19 bp, Homo sapiens
cactccatgaggtatttcc

SEQ ID NO: 772 - DNA, 18 bp, Homo sapiens
gaccccccaaagacacat

SEQ ID NO: 773 - DNA, 20 bp, Homo sapiens
gagacacagatctccaagat

SEQ ID NO: 774 - DNA, 15 bp, Homo sapiens
gggaggcggcccgtc

SEQ ID NO: 775 - DNA, 18 bp, Homo sapiens
gcgccgtggatagagcaa

SEQ ID NO: 776 - DNA, 20 bp, Homo sapiens
gaccaacacacagacttaca

SEQ ID NO: 777 - DNA, 20 bp, Homo sapiens
acaccctccagaatatgtat

SEQ ID NO: 778 - DNA, 17 bp, Homo sapiens
ggagccccgcttcattg

SEQ ID NO: 779 - DNA, 19 bp, Homo sapiens
ggattacatcgccctgaag

SEQ ID NO: 780 - DNA, 18 bp, Homo sapiens
caccctccagaggatgtg

SEQ ID NO: 781 - DNA, 18 bp, Homo sapiens
gcgccgtggatagagcaa

SEQ ID NO: 782 - DNA, 17 bp, Homo sapiens
cgagagaacctgcgcac

SEQ ID NO: 783 - DNA, 17 bp, Homo sapiens
gagaacctgcgcaccgc

SEQ ID NO: 784 - DNA, 19 bp, Homo sapiens
gtctcacaccctccagaat

SEQ ID NO: 785 - DNA, 16 bp, Homo sapiens
caggaggggccggagc

SEQ ID NO: 786 - DNA, 17 bp, Homo sapiens
ctgggcttctaccctgg

SEQ ID NO: 787 - DNA, 18 bp, Homo sapiens
cacagactgaccgagagg

SEQ ID NO: 788 - DNA, 16 bp, Homo sapiens
cgccgcggacacggca

SEQ ID NO: 789 - DNA, 16 bp, Homo sapiens
ctgctctggggggcag

SEQ ID NO: 790 - DNA, 16 bp, Homo sapiens
ccagagcgaggccggt

SEQ ID NO: 791 - DNA, 16 bp, Homo sapiens
ctccgtgtcccggcct

SEQ ID NO: 792 - DNA, 16 bp, Homo sapiens
cgcgggtaccaccagc

SEQ ID NO: 793 - DNA, 17 bp, Homo sapiens
tgaccgagacctgggct

SEQ ID NO: 794 - DNA, 17 bp, Homo sapiens
caggaggggccggagtt

SEQ ID NO: 795 - DNA, 17 bp, Homo sapiens
cgagagagcctgcggac

SEQ ID NO: 796 - DNA, 17 bp, Homo sapiens
cacggcggctcagatct

SEQ ID NO: 797 - DNA, 17 bp, Homo sapiens
cggagcagctgagagct

SEQ ID NO: 798 - DNA, 15 bp, Homo sapiens
ggcccgacgggcgct

SEQ ID NO: 799 - DNA, 17 bp, Homo sapiens
cgcgggcatgaccagtt

SEQ ID NO: 800 - DNA, 16 bp, Homo sapiens
ccatgtcccggcccgt

SEQ ID NO: 801 - DNA, 16 bp, Homo sapiens
gaccgcggcggacacc

SEQ ID NO: 802 - DNA, 16 bp, Homo sapiens
ctgcgacgtggggccc

SEQ ID NO: 803 - DNA, 16 bp, Homo sapiens
tccgaggacggagccc

SEQ ID NO: 804 - DNA, 15 bp, Homo sapiens
gagccccgggcgcca

SEQ ID NO: 805 - DNA, 16 bp, Homo sapiens
ccgcgagtccgaggac

SEQ ID NO: 806 - DNA, 20 bp, Homo sapiens
cacatcatccagaggatgtt

SEQ ID NO: 807 - DNA, 19 bp, Homo sapiens
cacagacttaccgagagaa

SEQ ID NO: 808 - DNA, 17 bp, Homo sapiens
catgtacggctgcgacc

SEQ ID NO: 809 - DNA, 17 bp, Homo sapiens
ctgcggaacctgcgcga

SEQ ID NO: 810 - DNA, 17 bp, Homo sapiens
catgaccagtccgcctg

SEQ ID NO: 811 - DNA, 18 bp, Homo sapiens
caccatccagaggatgtc

SEQ ID NO: 812 - DNA, 18 bp, Homo sapiens
gacctgagctcctggaca

SEQ ID NO: 813 - DNA, 17 bp, Homo sapiens
cgagagagcctgcgcac

SEQ ID NO: 814 - DNA, 15 bp, Homo sapiens
gcaggaggggccggg

SEQ ID NO: 815 - DNA, 18 bp, Homo sapiens
gaacctacctggagggca

SEQ ID NO: 816 - DNA, 18 bp, Homo sapiens
aacctacctggagggcat

SEQ ID NO: 817 - DNA, 16 bp, Homo sapiens
ctggaccgcggcggag

SEQ ID NO: 818 - DNA, 17 bp, Homo sapiens
tagagcaggaggggcca

SEQ ID NO: 819 - DNA, 18 bp, Homo sapiens
tctcacacttggcagacg

SEQ ID NO: 820 - DNA, 17 bp, Homo sapiens
ggcggagcagcggagaa

SEQ ID NO: 821 - DNA, 15 bp, Homo sapiens
cggcccggccgcgga

SEQ ID NO: 822 - DNA, 17 bp, Homo sapiens
ggtctcacaccctccac

SEQ ID NO: 823 - DNA, 19 bp, Homo sapiens
ccgcgggtataaccagtta

SEQ ID NO: 824 - DNA, 17 bp, Homo sapiens
ggcggagcagtggagaa

SEQ ID NO: 825 - DNA, 18 bp, Homo sapiens
gaatattgggaccgggag

SEQ ID NO: 826 - DNA, 17 bp, Homo sapiens
gcggctcagatcacccg

SEQ ID NO: 827 - DNA, 17 bp, Homo sapiens
cacaccctccagagcac

SEQ ID NO: 828 - DNA, 16 bp, Homo sapiens
agtgggaggcggccct

SEQ ID NO: 829 - DNA, 16 bp, Homo sapiens
gaccgagacctgggcg

SEQ ID NO: 830 - DNA, 17 bp, Homo sapiens
cgccacgagtccgagga

SEQ ID NO: 831 - DNA, 18 bp, Homo sapiens
gatctcccagcgcaagtt

SEQ ID NO: 832 - DNA, 16 bp, Homo sapiens
tggaggcggcccgtgt

SEQ ID NO: 833 - DNA, 17 bp, Homo sapiens
tgaccgagacctgggct

SEQ ID NO: 834 - DNA, 16 bp, Homo sapiens
gcgctcctggaccgcg

SEQ ID NO: 835 - DNA, 17 bp, Homo sapiens
agggcgagtgcgtggat

SEQ ID NO: 836 - DNA, 18 bp, Homo sapiens
ggtatttccacaccgcca

SEQ ID NO: 837 - DNA, 17 bp, Homo sapiens
ccgcgggcataaccaga

SEQ ID NO: 838 - DNA, 17 bp, Homo sapiens
ccggagtattgggaccc

SEQ ID NO: 839 - DNA, 18 bp, Homo sapiens
ggtctcacatcatccagg

SEQ ID NO: 840 - DNA, 17 bp, Homo sapiens
cgcctacgacggcaaga

SEQ ID NO: 841 - DNA, 17 bp, Homo sapiens
cgcgggcataaccagtc

SEQ ID NO: 842 - DNA, 17 bp, Homo sapiens
ccgggtctcacacttgg

SEQ ID NO: 843 - DNA, 19 bp, Homo sapiens
cacttggcagaggatgtat

SEQ ID NO: 844 - DNA, 17 bp, Homo sapiens
gagagagcctgcggaag

SEQ ID NO: 845 - DNA, 17 bp, Homo sapiens
cgggaaggacacgctgc

SEQ ID NO: 846 - DNA, 16 bp, Homo sapiens
cacgctgcagcgcgcg

SEQ ID NO: 847 - DNA, 19 bp, Homo sapiens
ccatctctgaccatgaggt

SEQ ID NO: 848 - DNA, 18 bp, Homo sapiens
cgggagacacagatctcg

SEQ ID NO: 849 - DNA, 16 bp, Homo sapiens
ggaggcggcccgtgtc

SEQ ID NO: 850 - DNA, 17 bp, Homo sapiens
agagaacctgcgcaccg

SEQ ID NO: 851 - DNA, 17 bp, Homo sapiens
gggagccccgcttcatt

SEQ ID NO: 852 - DNA, 16 bp, Homo sapiens
ctgcgcaccccgctcc

SEQ ID NO: 853 - DNA, 17 bp, Homo sapiens
ggccggagtattgggag

SEQ ID NO: 854 - DNA, 17 bp, Homo sapiens
ccgcgggcataaccagg

SEQ ID NO: 855 - DNA, 17 bp, Homo sapiens
ggcgagtgcgtggagtc

SEQ ID NO: 856 - DNA, 15 bp, Homo sapiens
cgggcgccgtgggtg

SEQ ID NO: 857 - DNA, 18 bp, Homo sapiens
gagagaacctgcggatcg

SEQ ID NO: 858 - DNA, 18 bp, Homo sapiens
gtggacgacacgctgttg

SEQ ID NO: 859 - DNA, 16 bp, Homo sapiens
tggagggcctgtgcgc

SEQ ID NO: 860 - DNA, 19 bp, Homo sapiens
gacggcaaggattacatca

SEQ ID NO: 861 - DNA, 18 bp, Homo sapiens
ccgcgggtataaccagtt

SEQ ID NO: 862 - DNA, 17 bp, Homo sapiens
ctccgcgggtataaccg

SEQ ID NO: 863 - DNA, 17 bp, Homo sapiens
gcggagcaggacagagt

SEQ ID NO: 864 - DNA, 19 bp, Homo sapiens
gagacacagaagtacaagc

SEQ ID NO: 865 - DNA, 17 bp, Homo sapiens
cgccaggcacagactgg

SEQ ID NO: 866 - DNA, 17 bp, Homo sapiens
tgtggtcgctgctgtgg

SEQ ID NO: 867 - DNA, 17 bp, Homo sapiens
cctgcggaacctgctcc

SEQ ID NO: 868 - DNA, 19 bp, Homo sapiens
agaaccttccagaagtgga

SEQ ID NO: 869 - DNA, 17 bp, Homo sapiens
agccccgcttcatctcc

SEQ ID NO: 870 - DNA, 19 bp, Homo sapiens
ccgcgggtataaccagtta

SEQ ID NO: 871 - DNA, 16 bp, Homo sapiens
ggcctgtgcgtggagg

SEQ ID NO: 872 - DNA, 16 bp, Homo sapiens
cggatcgcgctccgcg

SEQ ID NO: 873 - DNA, 18 bp, Homo sapiens
ttcgcctacgacggcaaa

SEQ ID NO: 874 - DNA, 18 bp, Homo sapiens
ctcctccgcgggcataaa

SEQ ID NO: 875 - DNA, 16 bp, Homo sapiens
gcgtctcctccgcggt

SEQ ID NO: 876 - DNA, 15 bp, Homo sapiens
cgggcgcctcctccc

SEQ ID NO: 877 - DNA, 17 bp, Homo sapiens
gagtccgaggacggaga

SEQ ID NO: 878 - DNA, 17 bp, Homo sapiens
atagagcaggaggggcg

SEQ ID NO: 879 - DNA, 18 bp, Homo sapiens
ccagaccagcaggagatg

SEQ ID NO: 880 - DNA, 17 bp, Homo sapiens
cagcatgaggggctgct

SEQ ID NO: 881 - DNA, 19 bp, Homo sapiens
cagacttaccgagagaact

SEQ ID NO: 882 - DNA, 16 bp, Homo sapiens
gcgacgccgcgagtca

SEQ ID NO: 883 - DNA, 15 bp, Homo sapiens
ccgcggggagccccc

SEQ ID NO: 884 - DNA, 17 bp, Homo sapiens
cgagagagcctgcggat

SEQ ID NO: 885 - DNA, 17 bp, Homo sapiens
gagagcctgcggatcgc

SEQ ID NO: 886 - DNA, 18 bp, Homo sapiens
ggcacagactgaccgagt

SEQ ID NO: 887 - DNA, 16 bp, Homo sapiens
gaccgccgcggacacc

SEQ ID NO: 888 - DNA, 15 bp, Homo sapiens
gcaggaggggccggc

SEQ ID NO: 889 - DNA, 16 bp, Homo sapiens
ccgcgagtccgagagg

SEQ ID NO: 890 - DNA, 19 bp, Homo sapiens
ggtctcacacttggcagat

SEQ ID NO: 891 - DNA, 16 bp, Homo sapiens
acggcaccccgaaccc

SEQ ID NO: 892 - DNA, 17 bp, Homo sapiens
ctcctcctgctgctctg

SEQ ID NO: 893 - DNA, 19 bp, Homo sapiens
agacacagaagtacaaggg

SEQ ID NO: 894 - DNA, 19 bp, Homo sapiens
ggtctcacatcatccaggt

SEQ ID NO: 895 - DNA, 17 bp, Homo sapiens
gcgggcatgaccagtct

SEQ ID NO: 896 - DNA, 16 bp, Homo sapiens
gaccgcggcggacaca

SEQ ID NO: 897 - DNA, 17 bp, Homo sapiens
gccggagtattgggacg

SEQ ID NO: 898 - DNA, 17 bp, Homo sapiens
cctcctccgcgggtata

SEQ ID NO: 899 - DNA, 18 bp, Homo sapiens
cacggcggctcagatcat

SEQ ID NO: 900 - DNA, 16 bp, Homo sapiens
tgcggatcgcgctccc

SEQ ID NO: 901 - DNA, 18 bp, Homo sapiens
gccggagtattgggacga

SEQ ID NO: 902 - DNA, 15 bp, Homo sapiens
ggaggcggcccgtgc

SEQ ID NO: 903 - DNA, 16 bp, Homo sapiens
cgacgccgcgagtcca

SEQ ID NO: 904 - DNA, 18 bp, Homo sapiens
gtcaccgtagctgtggtc

SEQ ID NO: 905 - DNA, 19 bp, Homo sapiens
gtgtaggaggaagagttct

SEQ ID NO: 906 - DNA, 18 bp, Homo sapiens
cagagcctacctggagga

SEQ ID NO: 907 - DNA, 18 bp, Homo sapiens
gtcatcggagctgtggtt

SEQ ID NO: 908 - DNA, 16 bp, Homo sapiens
cacctccgtgtcccgg

SEQ ID NO: 909 - DNA, 18 bp, Homo sapiens
cctccagagcatgtacgg

SEQ ID NO: 910 - DNA, 16 bp, Homo sapiens
ccgcgggcatgaccag

SEQ ID NO: 911 - DNA, 18 bp, Homo sapiens
catgaccagtacgcctac

SEQ ID NO: 912 - DNA, 16 bp, Homo sapiens
ggagcagcggagagcc

SEQ ID NO: 913 - DNA, 17 bp, Homo sapiens
gagcagcggagagccta

SEQ ID NO: 914 - DNA, 16 bp, Homo sapiens
ggagggcgagtgcgtg

SEQ ID NO: 915 - DNA, 16 bp, Homo sapiens
cgtggagtggctccgc

SEQ ID NO: 916 - DNA, 17 bp, Homo sapiens
acaagctggagcgcgct

SEQ ID NO: 917 - DNA, 17 bp, Homo sapiens
ctccgcaggtacctgga

SEQ ID NO: 918 - DNA, 18 bp, Homo sapiens
ggacgacacgcagttcgt

SEQ ID NO: 919 - DNA, 19 bp, Homo sapiens
aagaccaacacacagactg

SEQ ID NO: 920 - DNA, 18 bp, Homo sapiens
ggagcaggacagagccta

SEQ ID NO: 921 - DNA, 18 bp, Homo sapiens
cgcgggcataaccagtac

SEQ ID NO: 922 - DNA, 18 bp, Homo sapiens
cagtccaccatccccatc

SEQ ID NO: 923 - DNA, 18 bp, Homo sapiens
cctccagaggatgtacgg

SEQ ID NO: 924 - DNA, 20 bp, Homo sapiens
acacagatcttcaagaccaa

SEQ ID NO: 925 - DNA, 17 bp, Homo sapiens
tgaccagtccgcctacg

SEQ ID NO: 926 - DNA, 18 bp, Homo sapiens
cacagatctgcaaggccc

SEQ ID NO: 927 - DNA, 17 bp, Homo sapiens
ccgagagaacctgcgga

SEQ ID NO: 928 - DNA, 19 bp, Homo sapiens
tctcacatcatccagagga

SEQ ID NO: 929 - DNA, 18 bp, Homo sapiens
gaggatgtatggctgcga

SEQ ID NO: 930 - DNA, 16 bp, Homo sapiens
ctgcgacctggggccc

SEQ ID NO: 931 - DNA, 15 bp, Homo sapiens
ctggggcccgacggg

SEQ ID NO: 932 - DNA, 17 bp, Homo sapiens
gtacaagcgccaggcac

SEQ ID NO: 933 - DNA, 17 bp, Homo sapiens
aggcacaggctgaccga

SEQ ID NO: 934 - DNA, 17 bp, Homo sapiens
tgaccgagtgagcctgc

SEQ ID NO: 935 - DNA, 19 bp, Homo sapiens
ggtctcacatcatccagag

SEQ ID NO: 936 - DNA, 18 bp, Homo sapiens
catccagaggatgtacgg

SEQ ID NO: 937 - DNA, 17 bp, Homo sapiens
tccgcgggtatgaccag

SEQ ID NO: 938 - DNA, 20 bp, Homo sapiens
aagaccaacacacagactta

SEQ ID NO: 939 - DNA, 19 bp, Homo sapiens
acacagacttaccgagaga

SEQ ID NO: 940 - DNA, 16 bp, Homo sapiens
ggagggcacgtgcgtg

SEQ ID NO: 941 - DNA, 17 bp, Homo sapiens
gggaaggagacgctgga

SEQ ID NO: 942 - DNA, 17 bp, Homo sapiens
gaaggagacgctggagc

SEQ ID NO: 943 - DNA, 16 bp, Homo sapiens
ggagggcctgtgcgtg

SEQ ID NO: 944 - DNA, 16 bp, Homo sapiens
cgtggagtcgctccgc

SEQ ID NO: 945 - DNA, 16 bp, Homo sapiens
cggggagctccgcttc

SEQ ID NO: 946 - DNA, 16 bp, Homo sapiens
cgccgcgaacacggcg

SEQ ID NO: 947 - DNA, 17 bp, Homo sapiens
tgcgcggccactacaac

SEQ ID NO: 948 - DNA, 16 bp, Homo sapiens
ggagggcctgtgcgtg

SEQ ID NO: 949 - DNA, 16 bp, Homo sapiens
ggcccgtgtggcggag

SEQ ID NO: 950 - DNA, 17 bp, Homo sapiens
ggagcagctgagagcct

SEQ ID NO: 951 - DNA, 19 bp, Homo sapiens
cacagatctccaagaccaa

SEQ ID NO: 952 - DNA, 19 bp, Homo sapiens
acacagacttaccgagagg

SEQ ID NO: 953 - DNA, 16 bp, Homo sapiens
ccgagaggacctgcgg

SEQ ID NO: 954 - DNA, 17 bp, Homo sapiens
ccctgctccgctactac

SEQ ID NO: 955 - DNA, 18 bp, Homo sapiens
tatgaccaggacgcctac

SEQ ID NO: 956 - DNA, 18 bp, Homo sapiens
aggtatttcgacaccgcc

SEQ ID NO: 957 - DNA, 16 bp, Homo sapiens
caccgccatgtcccgg

SEQ ID NO: 958 - DNA, 15 bp, Homo sapiens
gagccgccggcgccg

SEQ ID NO: 959 - DNA, 16 bp, Homo sapiens
ggagggcacgtgcgtg

SEQ ID NO: 960 - DNA, 18 bp, Homo sapiens
gaggaagagctcaggtgg

SEQ ID NO: 961 - DNA, 17 bp, Homo sapiens
ccgcgctccgctactac

SEQ ID NO: 962 - DNA, 16 bp, Homo sapiens
cctgcggatcgcgctc

SEQ ID NO: 963 - DNA, 16 bp, Homo sapiens
gcggatcgcgctccgc

SEQ ID NO: 964 - DNA, 17 bp, Homo sapiens
tcgcgctccgctactac

SEQ ID NO: 965 - DNA, 17 bp, Homo sapiens
gaaggacacgctggagc

SEQ ID NO: 966 - DNA, 19 bp, Homo sapiens
acacacagaccttcaagac

SEQ ID NO: 967 - DNA, 18 bp, Homo sapiens
gacgatgtatggctgcga

SEQ ID NO: 968 - DNA, 17 bp, Homo sapiens
gggaccgggacacacag

SEQ ID NO: 969 - DNA, 17 bp, Homo sapiens
accaccaggacgcctac

SEQ ID NO: 970 - DNA, 18 bp, Homo sapiens
aacacacaggctgaccga

SEQ ID NO: 971 - DNA, 17 bp, Homo sapiens
gccctgggcttctaccc

SEQ ID NO: 972 - DNA, 17 bp, Homo sapiens
cacccagctcaagtggg

SEQ ID NO: 973 - DNA, 19 bp, Homo sapiens
cttggcagacgatgtatgg

SEQ ID NO: 974 - DNA, 19 bp, Homo sapiens
taaccagttagcctacgac

SEQ ID NO: 975 - DNA, 16 bp, Homo sapiens
ctgcgacctggggccg

SEQ ID NO: 976 - DNA, 19 bp, Homo sapiens
atcttcccaatccaccgtc

SEQ ID NO: 977 - DNA, 17 bp, Homo sapiens
gagagcctgcctggagg

SEQ ID NO: 978 - DNA, 19 bp, Homo sapiens
accctccagtggatgtatg

SEQ ID NO: 979 - DNA, 19 bp, Homo sapiens
agcaggagacagaaccttc

SEQ ID NO: 980 - DNA, 18 bp, Homo sapiens
atgggagccatcttccca

SEQ ID NO: 981 - DNA, 17 bp, Homo sapiens
tctacaccgccgtgtcc

SEQ ID NO: 982 - DNA, 20 bp, Homo sapiens
tccatgaggcatttctacac

SEQ ID NO: 983 - DNA, 18 bp, Homo sapiens
ggggccggaatattggga

SEQ ID NO: 984 - DNA, 17 bp, Homo sapiens
tccgcagacacctggag

SEQ ID NO: 985 - DNA, 16 bp, Homo sapiens
gacgctgcagcgcgcg

SEQ ID NO: 986 - DNA, 16 bp, Homo sapiens
ctctcgggagccctgg

SEQ ID NO: 987 - DNA, 17 bp, Homo sapiens
cgggcgccatggataga

SEQ ID NO: 988 - DNA, 18 bp, Homo sapiens
ggaccgggagacacagat

SEQ ID NO: 989 - DNA, 17 bp, Homo sapiens
cggagcagtggagagcc

SEQ ID NO: 990 - DNA, 18 bp, Homo sapiens
tcaggacaccgagcttgt

SEQ ID NO: 991 - DNA, 19 bp, Homo sapiens
cgacggcaaagattacatc

SEQ ID NO: 992 - DNA, 16 bp, Homo sapiens
tggaccgcggcggaca

SEQ ID NO: 993 - DNA, 18 bp, Homo sapiens
cgccctgaatgaggacct

SEQ ID NO: 994 - DNA, 18 bp, Homo sapiens
cagttcgtgcggttcgac

SEQ ID NO: 995 - DNA, 18 bp, Homo sapiens
gtggtcgctactgtgatg

SEQ ID NO: 996 - DNA, 18 bp, Homo sapiens
agaggatgtttggctgcg

SEQ ID NO: 997 - DNA, 19 bp, Homo sapiens
cacagatctgcaagaccaa

SEQ ID NO: 998 - DNA, 16 bp, Homo sapiens
aggatggctccccggg

SEQ ID NO: 999 - DNA, 16 bp, Homo sapiens
tgcgtggacgggctcc

SEQ ID NO: 1000 - DNA, 18 bp, Homo sapiens
gctcccacttcatgaggt

SEQ ID NO: 1001 - DNA, 17 bp, Homo sapiens
gcctccgcgcagactta

SEQ ID NO: 1002 - DNA, 18 bp, Homo sapiens
tggtggtgctttctggag

SEQ ID NO: 1003 - DNA, 17 bp, Homo sapiens
accaccccgtctctgac

SEQ ID NO: 1004 - DNA, 19 bp, Homo sapiens
accgggagatacagatctc

SEQ ID NO: 1005 - DNA, 16 bp, Homo sapiens
gaggatggcgccccgg

SEQ ID NO: 1006 - DNA, 17 bp, Homo sapiens
gaggatgtctggctgcg

SEQ ID NO: 1007 - DNA, 16 bp, Homo sapiens
cgcggacaaggcggct

SEQ ID NO: 1008 - DNA, 18 bp, Homo sapiens
ccctccagacgatgtacg

SEQ ID NO: 1009 - DNA, 18 bp, Homo sapiens
cctccagacgatgtacgg

SEQ ID NO: 1010 - DNA, 16 bp, Homo sapiens
aacctgcgcaccgcgc

SEQ ID NO: 1011 - DNA, 17 bp, Homo sapiens
aggacctgagctcctgg

SEQ ID NO: 1012 - DNA, 17 bp, Homo sapiens
gcttcatcgcagtgggc

SEQ ID NO: 1013 - DNA, 15 bp, Homo sapiens
atggcgccccgggcg

SEQ ID NO: 1014 - DNA, 16 bp, Homo sapiens
cgacgccacgagtccg

SEQ ID NO: 1015 - DNA, 18 bp, Homo sapiens
cagctgagaacctacctg

SEQ ID NO: 1016 - DNA, 18 bp, Homo sapiens
ccaacacacggacttacc

SEQ ID NO: 1017 - DNA, 17 bp, Homo sapiens
gggaaggagacgctgca

SEQ ID NO: 1018 - DNA, 18 bp, Homo sapiens
acgacacgctgttcgtga

SEQ ID NO: 1019 - DNA, 18 bp, Homo sapiens
cttaccgagtgaacctgc

SEQ ID NO: 1020 - DNA, 17 bp, Homo sapiens
ccgagtgaacctgcgga

SEQ ID NO: 1021 - DNA, 19 bp, Homo sapiens
ataaccagttcgcctacga

SEQ ID NO: 1022 - DNA, 18 bp, Homo sapiens
gtgaggttcaacagcgac

SEQ ID NO: 1023 - DNA, 17 bp, Homo sapiens
cacccagcacaagtggg

SEQ ID NO: 1024 - DNA, 18 bp, Homo sapiens
cggagcagctgagaacct

SEQ ID NO: 1025 - DNA, 19 bp, Homo sapiens
aggtatttccacacctccg

SEQ ID NO: 1026 - DNA, 19 bp, Homo sapiens
aaagacacatgtgacccac

SEQ ID NO: 1027 - DNA, 20 bp, Homo sapiens
atctccaagatcaacacaca

SEQ ID NO: 1028 - DNA, 16 bp, Homo sapiens
ggcccgtcaggcggag

SEQ ID NO: 1029 - DNA, 18 bp, Homo sapiens
gatagagcaagaggggcc

SEQ ID NO: 1030 - DNA, 19 bp, Homo sapiens
cagacttacagagagagcc

SEQ ID NO: 1031 - DNA, 19 bp, Homo sapiens
gaatatgtatggctgcgac

SEQ ID NO: 1032 - DNA, 18 bp, Homo sapiens
cgcttcattgcagtgggc

SEQ ID NO: 1033 - DNA, 17 bp, Homo sapiens
gccctgaaggaggacct

SEQ ID NO: 1034 - DNA, 18 bp, Homo sapiens
cttaccgagtgagcctgc

SEQ ID NO: 1035 - DNA, 17 bp, Homo sapiens
gaggatgtgcggctgcg

SEQ ID NO: 1036 - DNA, 18 bp, Homo sapiens
gatagagcaagaggggcc

SEQ ID NO: 1037 - DNA, 18 bp, Homo sapiens
cacagatctgcaaggcca

SEQ ID NO: 1038 - DNA, 16 bp, Homo sapiens
cctgcgcaccgcgctc

SEQ ID NO: 1039 - DNA, 15 bp, Homo sapiens
cgcaccgcgctccgc

SEQ ID NO: 1040 - DNA, 19 bp, Homo sapiens
cctccagaatatgtatggc

SEQ ID NO: 1041 - DNA, 17 bp, Homo sapiens
ggccggagcattgggac

SEQ ID NO: 1042 - DNA, 18 bp, Homo sapiens
tctaccctggggagatca

SEQ ID NO: 1043 - DNA, 18 bp, Homo sapiens
ggacacggcagctcagat

SEQ ID NO: 1044 - DNA, 16 bp, Homo sapiens
gggggcagtggccctg

SEQ ID NO: 1045 - DNA, 17 bp, Homo sapiens
gaggccggttctcacac

SEQ ID NO: 1046 - DNA, 15 bp, Homo sapiens
tcccggcctggccgc

SEQ ID NO: 1047 - DNA, 17 bp, Homo sapiens
accaccagcacgcctac

SEQ ID NO: 1048 - DNA, 16 bp, Homo sapiens
acctgggctggctccc

SEQ ID NO: 1049 - DNA, 16 bp, Homo sapiens
ggtcacggagccccga

SEQ ID NO: 1050 - DNA, 17 bp, Homo sapiens
gccggagttttgggacc

SEQ ID NO: 1051 - DNA, 19 bp, Homo sapiens
cctccagaatatgtacggc

SEQ ID NO: 1052 - DNA, 16 bp, Homo sapiens
cctgcggaccctgctc

SEQ ID NO: 1053 - DNA, 17 bp, Homo sapiens
ctcagatctcccagcgc

SEQ ID NO: 1054 - DNA, 18 bp, Homo sapiens
gctgagagcttacctgga

SEQ ID NO: 1055 - DNA, 15 bp, Homo sapiens
cgggcgttcctccgc

SEQ ID NO: 1056 - DNA, 18 bp, Homo sapiens
atgaccagttcgcctacg

SEQ ID NO: 1057 - DNA, 18 bp, Homo sapiens
cgcgggcataaccagttc

SEQ ID NO: 1058 - DNA, 15 bp, Homo sapiens
cggcccgtccgcggg

SEQ ID NO: 1059 - DNA, 16 bp, Homo sapiens
gcggacaccgcggctc

SEQ ID NO: 1060 - DNA, 19 bp, Homo sapiens
tctcacatcatccagagca

SEQ ID NO: 1061 - DNA, 15 bp, Homo sapiens
gtggggcccgacggg

SEQ ID NO: 1062 - DNA, 15 bp, Homo sapiens
acggagccccgggcg

SEQ ID NO: 1063 - DNA, 16 bp, Homo sapiens
tccgaggacggagccc

SEQ ID NO: 1064 - DNA, 18 bp, Homo sapiens
acctgcgcgactactaca

SEQ ID NO: 1065 - DNA, 16 bp, Homo sapiens
gtccgcctgcgacggc

SEQ ID NO: 1066 - DNA, 16 bp, Homo sapiens
tcctggacagcggcgg

SEQ ID NO: 1067 - DNA, 17 bp, Homo sapiens
ccgagagaacctgcgca

SEQ ID NO: 1068 - DNA, 17 bp, Homo sapiens
ggggccgggatattggg

SEQ ID NO: 1069 - DNA, 17 bp, Homo sapiens
tggagggcatgtgcgtg

SEQ ID NO: 1070 - DNA, 17 bp, Homo sapiens
ggagggcatgtgcgtgg

SEQ ID NO: 1071 - DNA, 15 bp, Homo sapiens
gcggcggagaccgcg

SEQ ID NO: 1072 - DNA, 18 bp, Homo sapiens
ggaggggccagaatattg

SEQ ID NO: 1073 - DNA, 18 bp, Homo sapiens
cttggcagacgatgtacg

SEQ ID NO: 1074 - DNA, 18 bp, Homo sapiens
ttggcagacgatgtacgg

SEQ ID NO: 1075 - DNA, 18 bp, Homo sapiens
cagcggagaacctacctg

SEQ ID NO: 1076 - DNA, 15 bp, Homo sapiens
ggccgcggagagccc

SEQ ID NO: 1077 - DNA, 18 bp, Homo sapiens
caccctccacaggatgta

SEQ ID NO: 1078 - DNA, 17 bp, Homo sapiens
cggagcagtggagaacc

SEQ ID NO: 1079 - DNA, 18 bp, Homo sapiens
cagtggagaacctacctg

SEQ ID NO: 1080 - DNA, 17 bp, Homo sapiens
gatcacccggcgcaagt

SEQ ID NO: 1081 - DNA, 17 bp, Homo sapiens
ccagagcacgtacggct

SEQ ID NO: 1082 - DNA, 16 bp, Homo sapiens
ggcggcccttgtggcg

SEQ ID NO: 1083 - DNA, 16 bp, Homo sapiens
acctgggcgggctccc

SEQ ID NO: 1084 - DNA, 17 bp, Homo sapiens
gtcacggcaccccgaac

SEQ ID NO: 1085 - DNA, 18 bp, Homo sapiens
aggtatttccacaccgcc

SEQ ID NO: 1086 - DNA, 17 bp, Homo sapiens
gtccgaggaaggagccg

SEQ ID NO: 1087 - DNA, 17 bp, Homo sapiens
gcgcaagttggaggcgg

SEQ ID NO: 1088 - DNA, 16 bp, Homo sapiens
acctgggctggctccc

SEQ ID NO: 1089 - DNA, 17 bp, Homo sapiens
tgcgtggattggctccg

SEQ ID NO: 1090 - DNA, 19 bp, Homo sapiens
cataaccagaacgcctacg

SEQ ID NO: 1091 - DNA, 17 bp, Homo sapiens
ttgggacccggagacac

SEQ ID NO: 1092 - DNA, 20 bp, Homo sapiens
atcatccaggtgatgtatgg

SEQ ID NO: 1093 - DNA, 19 bp, Homo sapiens
gacggcaagaattacatcg

SEQ ID NO: 1094 - DNA, 18 bp, Homo sapiens
ataaccagtccgcctacg

SEQ ID NO: 1095 - DNA, 16 bp, Homo sapiens
ctgcggaagctgcgcg

SEQ ID NO: 1096 - DNA, 19 bp, Homo sapiens
tcacacttggcagaggatg

SEQ ID NO: 1097 - DNA, 16 bp, Homo sapiens
cacgctgcagcgcgcg

SEQ ID NO: 1098 - DNA, 18 bp, Homo sapiens
accatgaggtcaccctga

SEQ ID NO: 1099 - DNA, 19 bp, Homo sapiens
acagatctcgaagaccaac

SEQ ID NO: 1100 - DNA, 16 bp, Homo sapiens
gcccgtgtcgcggagc

SEQ ID NO: 1101 - DNA, 15 bp, Homo sapiens
gcgcaccgcgctccg

SEQ ID NO: 1102 - DNA, 18 bp, Homo sapiens
ccgcttcattgcagtggg

SEQ ID NO: 1103 - DNA, 16 bp, Homo sapiens
cctgcgcaccccgctc

SEQ ID NO: 1104 - DNA, 17 bp, Homo sapiens
ccccgctccgctactac

SEQ ID NO: 1105 - DNA, 18 bp, Homo sapiens
gtattgggagcgggagac

SEQ ID NO: 1106 - DNA, 17 bp, Homo sapiens
gcgggcataaccaggac

SEQ ID NO: 1107 - DNA, 18 bp, Homo sapiens
cataaccaggacgcctac

SEQ ID NO: 1108 - DNA, 18 bp, Homo sapiens
ctccgcgggtataaccag

SEQ ID NO: 1109 - DNA, 16 bp, Homo sapiens
ccgtgggtggagcagg

SEQ ID NO: 1110 - DNA, 16 bp, Homo sapiens
gcggatcgcgctccgc

SEQ ID NO: 1111 - DNA, 18 bp, Homo sapiens
cacgctgttggtgaggtt

SEQ ID NO: 1112 - DNA, 16 bp, Homo sapiens
cctgtgcgcggagtcg

SEQ ID NO: 1113 - DNA, 19 bp, Homo sapiens
gattacatcaccctgaacg

SEQ ID NO: 1114 - DNA, 19 bp, Homo sapiens
ggtataaccggttagccta

SEQ ID NO: 1115 - DNA, 18 bp, Homo sapiens
aggacagagtctacctgg

SEQ ID NO: 1116 - DNA, 18 bp, Homo sapiens
aagtacaagcgccaggca

SEQ ID NO: 1117 - DNA, 18 bp, Homo sapiens
cacagactggccgagtga

SEQ ID NO: 1118 - DNA, 18 bp, Homo sapiens
gctgctgtggtgtgtagg

SEQ ID NO: 1119 - DNA, 18 bp, Homo sapiens
aacctgctccgctactac

SEQ ID NO: 1120 - DNA, 18 bp, Homo sapiens
cagaagtggacagctgtg

SEQ ID NO: 1121 - DNA, 15 bp, Homo sapiens
cagcgcgcggacccc

SEQ ID NO: 1122 - DNA, 18 bp, Homo sapiens
cttcatctccgtgggcta

SEQ ID NO: 1123 - DNA, 16 bp, Homo sapiens
cgtggaggggctccgc

SEQ ID NO: 1124 - DNA, 17 bp, Homo sapiens
cgctccgcgactacaac

SEQ ID NO: 1125 - DNA, 18 bp, Homo sapiens
cgggcataaacagtacgc

SEQ ID NO: 1126 - DNA, 18 bp, Homo sapiens
cctccgcggttataacca

SEQ ID NO: 1127 - DNA, 16 bp, Homo sapiens
cctcctccccgggcat

SEQ ID NO: 1128 - DNA, 16 bp, Homo sapiens
gacggagacccgggcg

SEQ ID NO: 1129 - DNA, 17 bp, Homo sapiens
ggaggggcgggagtatt

SEQ ID NO: 1130 - DNA, 18 bp, Homo sapiens
gcaggagatggaaccttc

SEQ ID NO: 1131 - DNA, 16 bp, Homo sapiens
ggggctgctgaagccc

SEQ ID NO: 1132 - DNA, 15 bp, Homo sapiens
cgggtcacggcgccc

SEQ ID NO: 1133 - DNA, 16 bp, Homo sapiens
tccgaggacggagccg

SEQ ID NO: 1134 - DNA, 18 bp, Homo sapiens
cgagagaacttgcggatc

SEQ ID NO: 1135 - DNA, 17 bp, Homo sapiens
cgcgagtcagaggacgg

SEQ ID NO: 1136 - DNA, 17 bp, Homo sapiens
ggagccccccttcatcg

SEQ ID NO: 1137 - DNA, 16 bp, Homo sapiens
ggggccggcgtattgg

SEQ ID NO: 1138 - DNA, 16 bp, Homo sapiens
tccgagaggggagccg

SEQ ID NO: 1139 - DNA, 19 bp, Homo sapiens
cttggcagatgatgtatgg

SEQ ID NO: 1140 - DNA, 17 bp, Homo sapiens
gtacaagggccaggcac

SEQ ID NO: 1141 - DNA, 19 bp, Homo sapiens
tcatccaggtgatgtatgg

SEQ ID NO: 1142 - DNA, 18 bp, Homo sapiens
tgaccagtctgcctacga

SEQ ID NO: 1143 - DNA, 16 bp, Homo sapiens
gcggacacagcggctc

SEQ ID NO: 1144 - DNA, 18 bp, Homo sapiens
tattgggacggggagaca

SEQ ID NO: 1145 - DNA, 18 bp, Homo sapiens
cgcgggtataaccagtac

SEQ ID NO: 1146 - DNA, 18 bp, Homo sapiens
ctcagatcatccagcgca

SEQ ID NO: 1147 - DNA, 17 bp, Homo sapiens
cgcgctcccctactaca

SEQ ID NO: 1148 - DNA, 18 bp, Homo sapiens
attgggacgaggagacac

SEQ ID NO: 1149 - DNA, 15 bp, Homo sapiens
gcccgtgcggcggag

SEQ ID NO: 1150 - DNA, 17 bp, Homo sapiens
gaaggagacgctgcagc

SEQ ID NO: 1151 - DNA, 17 bp, Homo sapiens
gcgagtccaagagggga

SEQ ID NO: 1152 - DNA, 17 bp, Homo sapiens
gctgtggtcgctgtggt

SEQ ID NO: 1153 - DNA, 17 bp, Homo sapiens
cctggaggacctgtgcg

SEQ ID NO: 1154 - DNA, 19 bp, Homo sapiens
agctgtggttgctactgtg

SEQ ID NO: 1155 - DNA, 21 bp, Homo sapiens
ctgagctcttcctcctacaca

SEQ ID NO: 1156 - DNA, 19 bp, Homo sapiens
tccttcccgttctccaggt

SEQ ID NO: 1157 - DNA, 18 bp, Homo sapiens
aggtctcggtcagggcca

SEQ ID NO: 1158 - DNA, 23 bp, Homo sapiens
gctcccactccatgaggtatttc

SEQ ID NO: 1159 - DNA, 1020 bp, Homo sapiens
  misc_feature (955)..(957): n is a, c, g, or t
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctannngcagttgtggtcatcggagctgtggtcgctgctgtgatgtgtaggaggaagagttcaggtgga

SEQ ID NO: 1160 - DNA, 1009 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcaggtacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagtt

SEQ ID NO: 1161 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1162 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaagaccaacacacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1163 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcaggacagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1164 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccatccccatcgtgggcattgttgctggcctggctgtcctagcagttgtggtcatcggagctgtggtcgctgctgtgatgtgtaggaggaagagttcaggtgga

SEQ ID NO: 1165 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1166 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagaggatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1167 - DNA, 546 bp, Homo sapiens
ggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgct

SEQ ID NO: 1168 - DNA, 619 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtccgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1169 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctgcaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1170 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagaacctgcggaacctgcgcggctactacaaccagagcgaggccgggtctcacaccctccagagcatgtacggctgcgacgtggggccggacgggcgcctcctccgcgggcatgaccagtccgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1171 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacatcatccagaggatgtatggctgcgacctggggcccgacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1172 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1173 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacatcatccagaggatgtacggctgcgacgtggggccggacgggcgcctcctccgcgggtatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1174 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacaggctgaccgagtgagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1175 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaagaccaacacacagacttaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1176 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1177 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacatcatccagaggatgtatggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1178 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcaggacagagcctacctggagggcacgtgcgtggagtggctccgcagatacctggagaacgggaaggagacgctggagcgcgcgg

SEQ ID NO: 1179 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcctgtgcgtggagtcgctccgcagatacctggagaacgggaaggacaagctggagcgcgctg

SEQ ID NO: 1180 - DNA, 546 bp, Homo sapiens
gctcccactccatgaggtatttctacacctccgtgtcccggcccggccgcggggagctccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1181 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcgaacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1182 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggccactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1183 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcctgtgcgtggagtggctccgcagatacctggagaacgggaaggacaagctggagcgcgctg

SEQ ID NO: 1184 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgtggcggagcaggacagagcctacctggagggcgagtgcgtggagtggctccgcagatacctggagaacgggaaggacaagctggagcgcgctg

SEQ ID NO: 1185 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagctgagagcctacctggagggcgagtgcgtggagtggctccgcagatacctggagaacgggaaggacaagctggagcgcgctg

SEQ ID NO: 1186 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctccaagaccaacacacagacttaccgagaggacctgcggaccctgctccgctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1187 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggtatgaccaggacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1188 - DNA, 546 bp, Homo sapiens
gctcccactccatgaggtatttcgacaccgccatgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1189 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgccggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1190 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggacaagctggagcgcgctg

SEQ ID NO: 1191 - DNA, 1017 bp, Homo sapiens
atgctggtcatggcgccccgaaccgtcctcctgctgctctcggcggccctggccctgaccgagacctgggccggctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1192 - DNA, 1017 bp, Homo sapiens
atgctggtcatggcgccccgaaccgtcctcctgctgctctcggcggccctggccctgaccgagacctgggccggctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagaacctgcgcaccgcgctccgctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1193 - DNA, 526 bp, Homo sapiens
ttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagacttaccgagagaacctgcggatcgcgctccgctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1194 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctccaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1195 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagaccttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1196 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagaacctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacaccgcggctcagatcacccagcgcaagtgggaggcggcccgtgaggcggagcagcggagagcctacctggagggcacgtgcgtggagtggctccgcagatacctggagaacgggaaggacacgctggagcgcgcgg

SEQ ID NO: 1197 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1198 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1199 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1200 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcgcgtgcgtggagtggctccgcagatacctggagaacgggaaggacacgctggagcgcgcgg

SEQ ID NO: 1201 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1202 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcagctgagagcctacctggagggcacgtgcgtggagtggctccgcagatacctggagaacgggaaggacacgctggagcgcgcgg

SEQ ID NO: 1203 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggtaccaccaggacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1204 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagactgaccgagtgagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1205 - DNA, 546 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacaggctgaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1206 - DNA, 822 bp, Homo sapiens
gctcccactccatgaggtatttcgacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacagactgaccgagagaacctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1207 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtatggctgcgacctggggccggacgggcgcctcctccgcgggcataaccagttagcctacgacggcaaggattacatcgccctgaacgaggacctgagctcctggaccgcggcggacaccgcggctcagatcacccagctcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1208 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagctcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1209 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1210 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacacttggcagacgatgtatggctgcgacctggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccaaagcccctcaccctgagatgggagccatcttcccaatccaccgtccccatcgtgggcattgttgctggcctggctgtcctagcagttgtggtcatcggagctgtggtcgctgctgtgatgtgtaggaggaagagctcaggtgga

SEQ ID NO: 1211 - DNA, 546 bp, Homo sapiens
gctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtatggctgcgacctggggccggacgggcgcctcctccgcgggcataaccagttagcctacgacggcaaggattacatcgccctgaacgaggacctgagctcctggaccgcggcggacaccgcggctcagatcacccagctcaagtgggaggcggcccgtgtggcggagcagctgagagcctacctggagggcacgtgcgtggagtggctccgcagatacctggagaacgggaaggagacgctgcagcgcgcgg

SEQ ID NO: 1212 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagctcaagtgggaggcggcccgtgtggcggagcagctgagagcctgcctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1213 - DNA, 546 bp, Homo sapiens
gctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagctcaagtgggaggcggcccgtgtggcggagcagctgagagcctacctggagggcgagtgcgtggagtggctccgcagatacctggagaacgggaaggagacgctgcagcgcgcgg

SEQ ID NO: 1214 - DNA, 546 bp, Homo sapiens
gctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacaccctccagaggatgtacggctgcgacgtggggccggacgggcgcctcctccgcgggtatgaccagtccgcctacgacggcaaggattacatcgccctgaacgaggacctgagctcctggaccgcggcggacaccgcggctcagatcacccagctcaagtgggaggcggcccgtgtggcggagcagctgagagcctacctggagggcgagtgcgtggagtggctccgcagatacctggagaacgggaaggagacgctgcagcgcgcgg

SEQ ID NO: 1215 - DNA, 822 bp, Homo sapiens
gctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacaccctccagaggatgtacggctgcgacctggggccggacgggcgcctcctccgcgggcataaccagttagcctacgacggcaaggattacatcgccctgaacgaggacctgagctcctggaccgcggcggacaccgcggctcagatcacccagctcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1216 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagtggatgtatggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1217 - DNA, 1017 bp, Homo sapiens
atgctggtcatggcgccccgaaccgtcctcctgctgctctcggcggccctggccctgaccgagacctgggccggctcccactccatgaggtatttctacaccgccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagtggatgtatggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1218 - DNA, 822 bp, Homo sapiens
gctcccactccatgaggtatttctacaccgccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagtggatgtatggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgaggcggagcagcggagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatggg

SEQ ID NO: 1219 - DNA, 546 bp, Homo sapiens
gctcccactccatgaggcatttctacaccgccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagaactgcaagaccaacacacagactgaccgagagagcctgcggaacctgcgcggctactacaaccagagcgaggccgggtctcacaccctccagtggatgtatggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcgg

SEQ ID NO: 1220 - DNA, 619 bp, Homo sapiens
atgctggtcatggcgccccgaaccgtcctcctgctgctctcggcggccctggccctgaccgagacctgggccggctcccactccatgaggtatttctacaccgccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagagcatgtacggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcgg

SEQ ID NO: 1221 - DNA, 546 bp, Homo sapiens
gctcccactccatgaggtatttctacaccgccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcgg

SEQ ID NO: 1222 - DNA, 546 bp, Homo sapiens
gctcccactccatgaggtatttctacaccgccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtatggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcgg

SEQ ID NO: 1223 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1224 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaagattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1225 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaatgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1226 - DNA, 546 bp, Homo sapiens
gctcccactccatgaggtatttctacaccgccatgtcccggcccggccgcggggagccccgcttcatcgcagtgggctacgtggacgacacgcagttcgtgcggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1227 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccggaacacacagatctccaagaccaacacacagacttaccgagagagcctgcggaacctgcgcggctactacaaccagagcgaggccgggtctcacatcatccagaggatgtatggctgcgacgtggggccggacgggcgcctcctccgcgggtatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1228 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1229 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacacttggcagacgatgtatggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1230 - DNA, 945 bp, Homo sapiens
ggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1231 - DNA, 945 bp, Homo sapiens
ggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtttggctgcgacgtggggccggacgggcgcctcctccgcgggtatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1232 - DNA, 945 bp, Homo sapiens
ggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1233 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccggaacacacagatcttcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1234 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaagattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1235 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtacgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1236 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccggaacacacagatctacaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1237 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggctccccgggcgccatggatagagcaggaggggccggagtattgggaccggaacacacagatctacaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1238 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggacgggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1239 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccggaacacacagatctccaagaccaacacacagacttaccgagagaacctgcggatcgcgctccgctactacaaccagagcgaggccgggtctcacatcatccagaggatgtatggctgcgacgtggggccggacgggcgcctcctccgcgggtatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1240 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtcgctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1241 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1242 - DNA, 1017 bp, Homo sapiens
atgcgggtcacggcgccccgaaccgtcctcctgctgctctcgggagccctggccctgaccgagacctgggccggctcccacttcatgaggtatttctacaccgccatgtcccggcccggccgcggggagccccgcttcatcgcagtgggctacgtggacgacacgcagttcgtgaggttcgacagcgacgccgcgagtccgaggatggcgccccgggcgccatggatagagcaggaggggccggagtattgggaccgggagacacggaacatgaaggcctccgcgcagacttaccgagagaacctgcggatcgcgctccgctactacaaccagagcgaggccgggtctcacacttggcagaggatgtatggctgcgacctggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1243 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacggaacatgaaggcctccgcgcagacttaccgagagaacctgcggatcgcgctccgctactacaaccagagcgaggccgggtctcacaccctccagaggatgtacggctgcgacgtggggccggacgggcgcctcctccgcgggtaccaccaggacgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1244 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1245 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggacgggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgctttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1246 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1247 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccggaacacacagatctgcaagaccaacacacagacttaccgagagagcctgcggaacctgcgcggctactacaaccagagcgaggccgggtctcacatcatccagaggatgtatggctgcgacgtggggccggacgggcgcctcctccgcgggtatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1248 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctgcaagaccaacacacagacttaccgagagaacctgcggatcgcgctccgctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1249 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagaacctgcggatcgcgctccgctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1250 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacatcatccagaggatgtatggctgcgacgtggggccggacgggcgcctcctccgcgggtatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1251 - DNA, 529 bp, Homo sapiens
gaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtttggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgc

SEQ ID NO: 1252 - DNA, 895 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagatacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1253 - DNA, 895 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1254 - DNA, 529 bp, Homo sapiens
gaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgc

SEQ ID NO: 1255 - DNA, 533 bp, Homo sapiens
gaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggtatgaccagtccgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1256 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtctggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1257 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgcgctcctggaccgccgcggacaaggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1258 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacctggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1259 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagacgatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1260 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtatggctgcgacgtggggccggacgggcgcctcctccgcgggtatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcgg

SEQ ID NO: 1261 - DNA, 546 bp, Homo sapiens
gctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtacgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1262 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagacacctggagaacgggaaggagacgctgcagcgcgcgg

SEQ ID NO: 1263 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcgg

SEQ ID NO: 1264 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcgagtgcgtggagtggctccgcagatacctggagaacgggaaggagacgctgcagcgcgcgg

SEQ ID NO: 1265 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1266 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagaggacctgcggaccctgctccgctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1267 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccggaacacacagatctgcaagaccaacacacagacttaccgagagagcctgcggaacctgcgcggctactacaaccagagcgaggccgggtctcacatcatccagaggatgtatggctgcgacgtggggccggacgggcgcctcctccgcgggtatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1268 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1269 - DNA, 619 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1270 - DNA, 546 bp, Homo sapiens
gctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagcggagagcctacctggagggcgagtgcgtggagtggctccgcagatacctggagaacgggaaggagacgctgcagcgcgcgg

SEQ ID NO: 1271 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgagctcctggaccgcggcggacaccgcggctcagatcacccagcgcaagtgggaggcggcccgtgtggcggagcagctgagaacctacctggagggcctgtgcgtggagtggctccgcagatacctggagaacgggaaggagacgctgcagcgcgcgg

SEQ ID NO: 1272 - DNA, 546 bp, Homo sapiens
gctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacggacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagcggagagcctacctggagggcgagtgcgtggagtggctccgcagatacctggagaacgggaaggagacgctgcagcgcgcgg

SEQ ID NO: 1273 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcgg

SEQ ID NO: 1274 - DNA, 546 bp, Homo sapiens
gctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgtggcggagcaggacagagcctacctggagggcctgtgcgtggagtggctccgcagatacctggagaacgggaaggagacgctgcagcgcgcgg

SEQ ID NO: 1275 - DNA, 619 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1276 - DNA, 619 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1277 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1278 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccggaacacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggtatgaccagtccgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1279 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatcttcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1280 - DNA, 615 bp, Homo sapiens
gggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagtgaacctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1281 - DNA, 619 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1282 - DNA, 546 bp, Homo sapiens
gctcccactccatgaggtatttctacaccgccatgtcccggcccggccgcggggagccccgcttcatcgcagtgggctacgtggacgacacccagttcgtgaggttcaacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1283 - DNA, 546 bp, Homo sapiens
gctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacagactgaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcgg

SEQ ID NO: 1284 - DNA, 546 bp, Homo sapiens
gctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcgg

SEQ ID NO: 1285 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtacgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1286 - DNA, 546 bp, Homo sapiens
gctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcgg

SEQ ID NO: 1287 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagcggagagcctacctggagggcctgtgcgtggagtggctccgcagatacctggagaacgggaaggagacgctgcagcgcgcgg

SEQ ID NO: 1288 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1289 - DNA, 546 bp, Homo sapiens
gctcccacttcatgaggtatttctacaccgccatgtcccggcccggccgcggggagccccgcttcatcgcagtgggctacgtggacgacacgcagttcgtgaggttcgacagcgacgccgcgagtccgaggatggcgccccgggcgccatggatagagcaggaggggccggagtattgggaccgggagacacggaacatgaaggcctccgcgcagacttaccgagagaacctgcggatcgcgctccgctactacaaccagagcgaggccgggtctcacacttggcagaggatgtatggctgcgacctggggccggacgggcgcctcctccgcgggcatgaccagtccgcctacgacggcaaggattacatcgccctgaacgaggacctgagctcctggaccgcggcggacacggcggctcagatcacccagcacaagtgggaggcggcccgtgaggcggagcagctgagagcctacctggagggcctgtgcgtggagtggctccgcagatacctggagaacgggaaggagacgctgcagcgcgcgg

SEQ ID NO: 1290 - DNA, 822 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1291 - DNA, 546 bp, Homo sapiens
gctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagaacctacctggagggcacgtgcgtggagtggctccgcagatacctggagaacgggaaggagacgctgcagcgcgcgg

SEQ ID NO: 1292 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagactgaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1293 - DNA, 822 bp, Homo sapiens
gctcccactccatgaggtatttccacacctccgtgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1294 - DNA, 822 bp, Homo sapiens
gctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgcgctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1295 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagttagcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1296 - DNA, 546 bp, Homo sapiens
gctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagatcaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcgg

SEQ ID NO: 1297 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtcaggcggagcagtggagagcctacctggagggcctgtgcgtggagtggctccgcagatacctggagaacgggaaggagacgctgcagcgcgcgg

SEQ ID NO: 1298 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1299 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttacagagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcgg

SEQ ID NO: 1300 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaatatgtatggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1301 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagactgaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1302 - DNA, 546 bp, Homo sapiens
gctcccactccatgaggtatttctacaccgccatgtcccggcccggccgcggggagccccgcttcattgcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcgg

SEQ ID NO: 1303 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaaggaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcgg

SEQ ID NO: 1304 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagtgagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1305 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatcttcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcgg

SEQ ID NO: 1306 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtgcggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcgg

SEQ ID NO: 1307 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagaacctgcgcaccgcgctccgctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcgg

SEQ ID NO: 1308 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1309 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcgg

SEQ ID NO: 1310 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcgg

SEQ ID NO: 1311 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagcggagagcctacctggagggcacgtgcgtggagtggctccgcagacacctggagaacgggaaggagacgctgcagcgcgcgg

SEQ ID NO: 1312 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcgg

SEQ ID NO: 1313 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcgg

SEQ ID NO: 1314 - DNA, 546 bp, Homo sapiens
gctcccactccatgaggtatttccacacctccgtgtcccggcccggccgcggggagccccgcttcatctcagtgggctacgtggacggcacccagttcgtgaggttcgacagcgacgccgcgagtccgaggacggagccccgggcgccgtggatagagcaagaggggccggagtattgggaccggaacacacagatctccaagaccaacacacagacttaccgagagagcctgcggaacctgcgcggctactacaaccagagcgaggccgggtctcacaccctccagaggatgtctggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagacacctggagaacgggaaggagacgctgcagcgcgcgg

SEQ ID NO: 1315 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagacttaccgagagaacctgcgcaccgcgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1316 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagagaacctgcggatcgcgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1317 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagcattgggaccgggagacacagatctgcaaggccaaggcacagactgaccgagaggacctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1318 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagagagcctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgaggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctggggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1319 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagaggacctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1320 - DNA, 427 bp, Homo sapiens
gctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagaggacctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcagctcagatcacccagcgcaagtgggaggcggcccgtgtggcggagcagctgagagcctacctggagggcgagtgcgtggagtggct

SEQ ID NO: 1321 - DNA, 619 bp, Homo sapiens
atgcgggtcacggcgccccgaaccctcctcctgctgctctggggggcagtggccctgaccgagacctgggccggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagaggacctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1322 - DNA, 895 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagaggacctgcggaccctgctccgctactacaaccagagcgaggccggttctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1323 - DNA, 546 bp, Homo sapiens
gctcccactccatgaggtatttccacacctccgtgtcccggcctggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagaggacctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1324 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagagagcctgcggaccctgctccgctactacaaccagagcgaggccgggtctcacaccctccagaatatgtatggctgcgacgtggggccggacgggcgcctcctccgcgggtatgaccagtacgcctacgacggcaaggattacatcgccctgaacgaggacctgagctcctggaccgccgcggacacggcggctcagatcacccagcgcaagtgggaggcggcccgtgaggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctggggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1325 - DNA, 945 bp, Homo sapiens
ggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagaggacctgcggaccctgctccgctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1326 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagagagcctgcggaacctgcgcggctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1327 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagaggacctgcggaccctgctccgctactacaaccagagcgaggccgggtctcacaccctccagaatatgtatggctgcgacgtggggccggacgggcgcctcctccgcgggtaccaccagcacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1328 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagaggacctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgaggcggagcagctgagagcctacctggagggcgagtgcgtggagtggctccgcagatacctggagaacgggaaggagacgctgcagcgcgcgg

SEQ ID NO: 1329 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagagagcctgcggaccctgctccgctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1330 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaagaccaacacacagactgaccgagagagcctgcggaacctgcgcggctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1331 - DNA, 1017 bp, Homo sapiens
atgcgggtcacggagccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagaggacctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1332 - DNA, 619 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagaggacctgcggaccctgctccgctactacaaccagagcgaggccgggtctcacacttggcagacgatgtatggctgcgacctggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1333 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagagagcctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1334 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaagaccaacacacagactgaccgagaggacctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1335 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagttttgggaccgggagacacagatctgcaaggccaaggcacagactgaccgagaggacctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1336 - DNA, 619 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgaggcggagcagctgagagcctacctggagggcgagtgcgtggagtggctccgcagatacctggagaacgggaaggagacgctgcagcgcgcgg

SEQ ID NO: 1337 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagaggacctgcggaccctgctccgctactacaaccagagcgaggccgggtctcacatcatccagaggatgtacggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1338 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagagagcctgcggaccctgctccgctactacaaccagagcgaggccgggtctcacaccctccagaatatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgaggcggagcagctgagagcctacctggagggcgagtgcgtggagtggctccgcagatacctggagaacgggaaggagacgctgcagcgcgcgg

SEQ ID NO: 1339 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagagagcctgcggaccctgctccgctactacaaccagagcgaggccgggtctcacaccctccagaggatgtacggctgcgacgtggggccggacgggcgcctcctccgcgggtatgaccagtacgcctacgacggcaaggattacatcgccctgaacgaggacctgagctcctggaccgccgcggacacggcggctcagatcacccagcgcaagtgggaggcggcccgtgaggcggagcagctgagagcctacctggagggcgagtgcgtggagtggctccgcagatacctggagaacgggaaggagacgctgcagcgcgcgg

SEQ ID NO: 1340 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccggaacacacagatcttcaagaccaacacacagacttaccgagagagcctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1341 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagagagcctgcggaccctgctccgctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagtgggaggcggcccgtgaggcggagcagctgagagcctacctggagggcgagtgcgtggagtggctccgcagatacctggagaacgggaaggagacgctgcagcgcgcgg

SEQ ID NO: 1342 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccgcgagtccgagagaggagccgcgggcgccgtggatagagcaggaggggccggagtattgggaccgggagacacagatctgcaaggccaaggcacagactgaccgagagagcctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1343 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1344 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcttacctggagggcctgtgcgtggagtggctccgcagatacctggagaacgggaaggagacgctgcagcgcgcgg

SEQ ID NO: 1345 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcttcctccgcgggcataaccagtacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1346 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1347 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcataaccagtacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1348 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacaccctccagagcatgtacggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1349 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1350 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccgtccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1351 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagcggagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1352 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1353 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1354 - DNA, 525 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccgggagacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacggga

SEQ ID NO: 1355 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1356 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtacggctgcgacgtggggccggacgggcgcctcctccgcgggcataaccagtacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1357 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccgggagacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1358 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1359 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1360 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccgggagacacagatcttcaagaccaacacacagacttaccgagagagcctgcggaacctgcgcggctactacaaccagagcgaggccgggtctcacatcatccagagcatgtacggctgcgacgtggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1361 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagagcatgtacggctgcgacgtggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1362 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagcggagagcctacctggagggcctgtgcgtggagtggctccgcagatacctggagaacgggaaggagacgctgcagcgcgcgg

SEQ ID NO: 1363 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggaaggagccgcgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1364 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatctccaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1365 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1366 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1367 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtttggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1368 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagacacctggagaacgggaaggagacgctgcagcgcgcgg

SEQ ID NO: 1369 - DNA, 546 bp, Homo sapiens
gctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1370 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgagagaggagccccgggcgccatggatagagcaggaggggccggaatattgggaccggaacacacagatctgcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1371 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1372 - DNA, 619 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccgggagacacagatctccaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1373 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagactgaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1374 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagagcatgtacggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1375 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1376 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacaccctccagaggatgtacggctgcgacgtggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1377 - DNA, 564 bp, Homo sapiens
tgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1378 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1379 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1380 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcgactactacaaccagagcgaggccgggtctcacatcatccagaggatgtatggctgcgacctggggcccgacgggcgcctcctccgcgggcatgaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1381 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacacttggcagacgatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1382 - DNA, 548 bp, Homo sapiens
  misc_feature (547)..(547): n is a, c, g, or t
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagttcgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtggctccgcagatacctggagaacgggaaggagacgctgcagcgcgcgdna

SEQ ID NO: 1383 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtacggctgcgacgtggggccggacgggcgcctcctccgcgggcatgaccagtacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1384 - DNA, 912 bp, Homo sapiens
gggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctgcgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcct

SEQ ID NO: 1385 - DNA, 1012 bp, Homo sapiens
atgcgggtcacggcgccccgaaccctcctcctgctgctctggggggcagtggccctgaccgagacctgggctggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcag

SEQ ID NO: 1386 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1387 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1388 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagcggagagcctacctggagggcctgtgcgtggagtcgctccgcagatacctggagaacgggaaggagacgctgcagcgcgcgg

SEQ ID NO: 1389 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacgacacccagttcgtgaggttcgacagcgacgccgcgagtccgaggacggagccccgggcgccgtggatagagcaggaggggccggagtattgggaccgggagacacagatctccaagaccaacacacagacttaccgagaggacctgcggaccctgctccgctactacaaccagagcgaggccgggtctcacaccatccagaggatgtctggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgtggcggagcaggacagagcctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1390 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacgacacccagttcgtgaggttcgacagcgacgccgcgagtccgaggacggagccccgggcgccgtggatagagcaggaggggccggagtattgggaccgggagacacagatctccaagaccaacacacagacttaccgagaggacctgcggaccctgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1391 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacgacacccagttcgtgaggttcgacagcgacgccgcgagtccgaggacggagccccgggcgccgtggatagagcaggaggggccggagtattgggaccgggagacacagatctccaagaccaacacacagacttaccgagaggacctgcggaccctgctccgctactacaaccagagcgaggccgggtctcacaccatccagaggatgtctggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgtggcggagcaggacagagcctacctggagggcacgtgcgtggagtggctccgcagacacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1392 - DNA, 619 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatctcagtgggctacgtggacgacacccagttcgtgaggttcgacagcgacgccgcgagtccgaggacggagccccgggcgccgtggatagagcaggaggggccggagtattgggaccgggagacacagatctccaagaccaacacacagacttaccgagaggacctgcggaacctgcgcggctactacaaccagagcgaggccgggtctcacaccatccagaggatgtctggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgtggcggagcaggacagagcctacctggagggcacgtgcgtggagtggctccgcagatacctggagaacgggaaggagacgctgcagcgcgcgg

SEQ ID NO: 1393 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagacttaccgagagaacctgcggatcgcgctccgctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1394 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagacttaccgagagaacctgcgcaccgcgctccgctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1395 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagacttaccgagagaacctgcgcaccgcgctccgctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggacagcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1396 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccgggagacacagatctccaagaccaacacacagactgaccgagagagcctgcgcaccgcgctccgctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1397 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctgcaagaccaacacacagacttaccgagagaacctgcgcaccgcgctccgctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1398 - DNA, 822 bp, Homo sapiens
gctcccactccatgaggtatttctacaccgccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagacttaccgagagaacctgcggatcgcgctccgctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatggg

SEQ ID NO: 1399 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1400 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgaggacggagccccgggcgccatggatagagcaggaggggccgggatattgggaccggaacacacagatcttcaagaccaacacacagacttaccgagagaacctgcggatcgcgctccgctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1401 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagacttaccgagagaacctgcgcaccgcgctccgctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcatgtgcgtggagtggctccgcagatacctggagaacgggaaggagacgctgcagcgcgcgg

SEQ ID NO: 1402 - DNA, 548 bp, Homo sapiens
  misc_feature (547)..(547): n is a, c, g, or t
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagacttaccgagagaacctgcggatcgcgctccgctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggagaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgdna

SEQ ID NO: 1403 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1404 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1405 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccagaatattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1406 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccgggagacacagatctccaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1407 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1408 - DNA, 993 bp, Homo sapiens
gtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1409 - DNA, 1017 bp, Homo sapiens
atgctggtcatggcgccccgaaccgtcctcctgctgctctcggcggccctggccctgaccgagacctgggccggctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1410 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1411 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacacttggcagacgatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1412 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacacttggcagacgatgtatggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1413 - DNA, 413 bp, Homo sapiens
ggttcgacagcgacgccgcgagtccgagagaggagccgcgggcgccgtggatagagcaggaggggccggaatattgggaccggaacacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctg

SEQ ID NO: 1414 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagcggagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1415 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtctggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1416 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctacaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1417 - DNA, 677 bp, Homo sapiens
tacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagcggagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccag

SEQ ID NO: 1418 - DNA, 546 bp, Homo sapiens
gctcccactccatgaggtatttcgacaccgccgtgtcccggcccggccgcggagagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1419 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1420 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1421 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcatgaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1422 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctacaagaccaacacacagactgaccgagagagcctgcggaacctgcgcggctactacaaccagagcgaggccgggtctcacaccctccacaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1423 - DNA, 619 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctacaagaccaacacacagactgaccgagagagcctgcggaacctgcgcggctactacaaccagagcgaggccgggtctcacaccctccagaggatgtacggctgcgacgtggggccggacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1424 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacacggcggctcagatcacccagcgcaagtgggaggcggcccgtgaggcggagcagtggagaacctacctggagggcacgtgcgtggagtggctccgcagatacctggagaacgggaaggagacgctgcagcgcgcgg

SEQ ID NO: 1425 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgaggacggagccccgggcgccatggatagagcaggaggggccggagtattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1426 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctacaagaccaacacacagacttaccgagagaacctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1427 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccgggagacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1428 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccgggagacacagatctccaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccggcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1429 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagagcacgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1430 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccttgtggcggagcagctgagaacctacctggagggcacgtgcgtggagtggctccgcagatacctggagaacgggaaggagacgctgcagcgcgcgg

SEQ ID NO: 1431 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagtgagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcgg

SEQ ID NO: 1432 - DNA, 1017 bp, Homo sapiens
atgcgggtcacggcaccccgaaccgtcctcctgctgctctcggcggccctggccctgaccgagacctgggcgggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1433 - DNA, 1017 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1434 - DNA, 822 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1435 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1436 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcatgaccagtccgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1437 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacatcatccagaggatgtatggctgcgacctggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1438 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1439 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1440 - DNA, 1017 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatcttcaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1441 - DNA, 1017 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccggaacacacagatcttcaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1442 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggtatgaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1443 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1444 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1445 - DNA, 619 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatctcagtgggctacgtggacgacacgcagttcgtgaggttcgacagcgacgccgcgagtccgagagaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1446 - DNA, 619 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatcttcaagaccaacacacagacttaccgagagaacctgcggatcgcgctccgctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1447 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcagctgagagcctacctggagggcgagtgcgtggagtggctccgcagatacctggagaacgggaaggacaagctggagcgcgctg

SEQ ID NO: 1448 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgcggcggacacggcggctcagatcacccagcgcaagtgggaggcggcccgtgtggcggagcagctgagagcctacctggagggcgagtgcgtggagtggctccgcagatacctggagaacgggaaggacaagctggagcgcgctg

SEQ ID NO: 1449 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggattggctccgcagatacctggagaacgggaaggacaagctggagcgcgctg

SEQ ID NO: 1450 - DNA, 619 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1451 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1452 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcggatcgcgctccgctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1453 - DNA, 619 bp, Homo sapiens
atgcgggtcacggcgccccgaaccctcctcctgctgctctggggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1454 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1455 - DNA, 619 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1456 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacctggggcccgacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1457 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccggaacacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1458 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaagattacatcgccctgaacgaggacctgagctcctggaccgcggcggacacggcggctcagatcacccagcgcaagtgggaggcggcccgtgaggcggagcagctgagagcctacctggagggcctgtgcgtggagtggctccgcagatacctggagaacgggaaggagacgctgcagcgcgcgg

SEQ ID NO: 1459 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagaacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1460 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacatcatccagaggatgtatggctgcgacctggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1461 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggacccggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1462 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacatcatccaggtgatgtatggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1463 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1464 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1465 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcatgaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1466 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacatcatccaggtgatgtatggctgcgacgtggggccggacgggcgcctcctccgcgggcataaccagtacgcctacgacggcaagaattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1467 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1468 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1469 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1470 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtccgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1471 - DNA, 912 bp, Homo sapiens
gggggcagtggccctgaccgagacctgggctggctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcacgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcct

SEQ ID NO: 1472 - DNA, 546 bp, Homo sapiens
gctcccactccatgaggtatttctacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1473 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggtatgaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1474 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1475 - DNA, 546 bp, Homo sapiens
gctcccactccatgaggtatttccacacctccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagacgatgtatggctgcgacgtggggccggacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1476 - DNA, 1017 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagaggatgtatggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1477 - DNA, 1017 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1478 - DNA, 546 bp, Homo sapiens
gctcccactccatgaggtatttccacaccgccatgtcccggcccggccgcggagagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1479 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacctggggcccgacgggcgcctcctccgcgggcatgaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1480 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaagctgcgcggctactacaaccagagcgaggccgggtctcacacttggcagaggatgtatggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1481 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagaggatgtatggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctgcagcgcgcgg

SEQ ID NO: 1482 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1483 - DNA, 547 bp, Homo sapiens
ggctcccactccatgaggtatttccacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1484 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggacagagcctacctggagggcacgtgcgtggagtggctccgcagatacctggagaacgggaaggacacgctggagcgcgcgg

SEQ ID NO: 1485 - DNA, 1052 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggactgctgtgatgtgtaggaggaagagctcaggtgga

SEQ ID NO: 1486 - DNA, 822 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctcgaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1487 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtcgcggagcaggacagagcctacctggagggcctgtgcgtggagtcgctccgcagatacctggagaacgggaaggagacgctgcagcgcgcgg

SEQ ID NO: 1488 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1489 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtatggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1490 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagcggagagcctacctggagggcacgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1491 - DNA, 404 bp, Homo sapiens
ggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccagtacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1492 - DNA, 619 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1493 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccgcgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtatggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1494 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccgcgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1495 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1496 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtttggctgcgacctggggcccgacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcgg

SEQ ID NO: 1497 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccccgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1498 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccggaacacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1499 - DNA, 1017 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggagcgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtgga

SEQ ID NO: 1500 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggcataaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1501 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcgcaccgcgctccgctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1502 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcgagtgcgtggagtggctccgcagatacctggagaacgggaaggagacgctgcagcgcgcgg

SEQ ID NO: 1503 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1504 - DNA, 619 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcggatcgcgctccgctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1505 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacacttggcagacgatgtatggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1506 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcgagtgcgtggagtcgctccgcagatacctggagaacgggaaggagacgctgcagcgcgcgg

SEQ ID NO: 1507 - DNA, 546 bp, Homo sapiens
gctcccactccatgaggtatttctacaccgccgtgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1508 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccgtgggtggagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1509 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcggatcgcgctccgctactacaaccagagcgaggccgggtctcacatcatccagaggatgtacggctgcgacgtggggccggacgggcgcctcctccgcgggtatgaccagtacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1510 - DNA, 546 bp, Homo sapiens
gctcccactccatgaggtatttctacaccgccatgtcccggcccggccgcggggagccccgcttcatcaccgtgggctacgtggacgacacgctgttggtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcgg

SEQ ID NO: 1511 - DNA, 822 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1512 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtatggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagcggagagcctacctggagggcctgtgcgtggagtcgctccgcagatacctggagaacgggaaggagacgctgcagcgcgcgg

SEQ ID NO: 1513 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagaacctacctggagggcctgtgcgtggagtcgctccgcagatacctggagaacgggaaggagacgctgcagcgcgcgg

SEQ ID NO: 1514 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgcggagtcgctccgcagatacctggagaacgggaaggagacgctgcagcgcgcgg

SEQ ID NO: 1515 - DNA, 895 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtcgctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1516 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggacccggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcgg

SEQ ID NO: 1517 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcaccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1518 - DNA, 1017 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1519 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagaggatgtatggctgcgacctggggcccgacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1520 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagaggatgtatggctgcgacctggggcccgacgggcgcctcctccgcgggtataaccggttagcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1521 - DNA, 1017 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1522 - DNA, 543 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgtggcggagcaggacagagtctacctggagggcctgtgcgtggagtcgctccgcagatacctggagaacgggaaggagacgctgcagcgcg

SEQ ID NO: 1523 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctacaaggcccaggcacagactgaccgagagagcctgcggaacctgcgcggctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcgg

SEQ ID NO: 1524 - DNA, 1017 bp, Homo sapiens
atgcgggtcacggcgccccgaaccgtcctcctgctgctctcgggagccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagaagtacaagcgccaggcacagactgaccgagtgagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1525 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggaccgggagacacagaagtacaagcgccaggcacagactggccgagtgagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcgg

SEQ ID NO: 1526 - DNA, 1017 bp, Homo sapiens
atgcgggtcacggcgccccgaaccctcctcctgctgctctggggggcagtggccctgaccgagacctgggctggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagaggacctgcggaccctgctccgctactacaaccagagcgaggccgggtctcacaccctccagaggatgtttggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtggtgtgtaggaggaagagctcaggtgga

SEQ ID NO: 1527 - DNA, 904 bp, Homo sapiens
gcgggtcacggcgccccgaaccctcctcctgctgctctggggggcagtggccctgaccgagacctgggctggctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacaccctccagaggatgtttggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcc

SEQ ID NO: 1528 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgctccgctactacaaccagagcgaggccgggtctcacaccctccagaggatgtttggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1529 - DNA, 546 bp, Homo sapiens
gctcccactccatgaggtatttctacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacaccctccagaatatgtatggctgcgacgtggggccggacgggcgcctcctccgcgggtaccaccaggacgcctacgacggcaaggattacatcgccctgaacgaggacctgagctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1530 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtggacagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1531 - DNA, 993 bp, Homo sapiens
gtcctcctgctgctctcggcggccctggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1532 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1533 - DNA, 822 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtggacagctgtggtggtgccttctggagaagagcagagatacacatgccatgtacagcatgaggggctgccgaagcccctcaccctgagatggg

SEQ ID NO: 1534 - DNA, 619 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctccgtgggctacgtggacgacacccagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgaggcggagcagcggagagcctacctggagggcgagtgcgtggagtggctccgcagatacctggagaacgggaaggacaagctggagcgcgctg

SEQ ID NO: 1535 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatcttcaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1536 - DNA, 546 bp, Homo sapiens
gctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccgggagacacagatctccaagaccaacacacagacttaccgagagagcctgcggaacctgcgcggctactacaaccagagcgaggccgggtctcacaccctccagagcatgtacggctgcgacgtggggccggacgggcgcctcctccgcgggcataaccagttcgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctg

SEQ ID NO: 1537 - DNA, 1017 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcggatcgcgctccgctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1538 - DNA, 820 bp, Homo sapiens
tcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagaacctgcgcaccgcgctccgctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1539 - DNA, 546 bp, Homo sapiens
gctcccactccatgaggtatttccacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccgggagacacagatctccaagaccaacacacagacttaccgagagaacctgcggatcgcgctccgctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcgg

SEQ ID NO: 1540 - DNA, 1017 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1541 - DNA, 1017 bp, Homo sapiens
atgcgggtcacggcaccccgaaccgtcctcctgctgctctcggcggccctggccctgaccgagacctgggccggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagaggatgtatggctgcgacctggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtcgctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1542 - DNA, 546 bp, Homo sapiens
gctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaccgggagacacagatctccaagaccaacacacagacttaccgagagagcctgcggaacctgcgcggctactacaaccagagcgaggccgggtctcacacttggcagaggatgtacggctgcgacgtggggcccgacgggcgcctcctccgcgggtataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcgg

SEQ ID NO: 1543 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1544 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1545 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccgtggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1546 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1547 - DNA, 1012 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacatgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcag

SEQ ID NO: 1548 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1549 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1550 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggaggggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1551 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacatcatccagaggatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1552 - DNA, 822 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgtggcggagcagcggagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1553 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacaccctccagaggatgtacggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1554 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatctccaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1555 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgtggcggagcaggacagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1556 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagacacctggagaacgggaaggagacgctgcagcgcgcgg

SEQ ID NO: 1557 - DNA, 677 bp, Homo sapiens
tacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccag

SEQ ID NO: 1558 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgcgactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1559 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1560 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagttcgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1561 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaacagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1562 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1563 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcgagtgcgtggagtggctccgcagacacctggagaacgggaaggagacgctgcagcgcgcgg

SEQ ID NO: 1564 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgtctcctccgcggttataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1565 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccccgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1566 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgtggcggagcagctgagaacctacctggagggcctgtgcgtggagtggctccgcagacacctggagaacgggaaggagacgctgcagcgcgcgg

SEQ ID NO: 1567 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagactgaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgtggcggagcaggacagagcctacctggagggcctgtgcgtggagtggctccgcagacacctggagaacgggaaggagacgctgcagcgcgcgg

SEQ ID NO: 1568 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagacacctggagaacgggaaggagacgctgcagcgcgcgg

SEQ ID NO: 1569 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatctgcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1570 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtcgctccgcagatacctggagaacgggaaggagacgctgcagcgcgcgg

SEQ ID NO: 1571 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1572 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagacccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1573 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggcgggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1574 - DNA, 822 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagcggagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1575 - DNA, 822 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatggaaccttccagaagtgggcagctgtggtggtgccttctggagaagagcagagatacacatgccatgtacagcatgaggggctgccgaagcccctcaccctgagatggg

SEQ ID NO: 1576 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgtggcggagcagctgagagcctacctggagggcgagtgcgtggagtggctccgcagacacctggagaacgggaaggagacgctgcagcgcgcgg

SEQ ID NO: 1577 - DNA, 822 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgctgaagcccctcaccctgagatggg

SEQ ID NO: 1578 - DNA, 546 bp, Homo sapiens
gctcccacttcatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1579 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcgagtgcgtggagtggctccgcagatacctggagaacgggaaggagacgctgcagcgcgcgg

SEQ ID NO: 1580 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccgggagacacagatctccaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1581 - DNA, 993 bp, Homo sapiens
gtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccgggagacacagatctccaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1582 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccgcgggcgccatggatagagcaggaggggccggagtattgggaccgggagacacagatctccaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1583 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccgggagacacagatctccaagaccaacacacagacttaccgagagaacttgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1584 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggatggcgccccgggcgccatggatagagcaggaggggccggagtattgggaccgggagacacagatctccaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1585 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccgggagacacagatctccaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1586 - DNA, 1012 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtcagaggacggagccccgggcgccatggatagagcaggaggggccggagtattgggaccgggagacacagatctccaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcag

SEQ ID NO: 1587 - DNA, 546 bp, Homo sapiens
gctcccactccatgaggtatttctacaccgccatgtcccggcccggccgcggggagccccccttcatcgcagtgggctacgtggacgacacccagttcgtgaggttcgacagcgacgccgcgagtccgaggacggagccccgggcgccatggatagagcaggaggggccggagtattgggaccgggagacacagatctccaagaccaacacacagacttaccgagagaacctgcggatcgcgctccgctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1588 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1589 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagacacctggagaacgggaaggagacgctgcagcgcgcgg

SEQ ID NO: 1590 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagaggacctgcggaccctgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1591 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacatcatccagaggatgtatggctgcgacctggggcccgacgggcgcctcctccgcgggcatgaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1592 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1593 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1594 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacaccatccagaggatgtctggctgcgacgtggggccggacgggcgcctcctccgcgggtataaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1595 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagaacctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcgg

SEQ ID NO: 1596 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatctccaagaccaacacacagacttaccgagagaacctgcgcaccgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1597 - DNA, 1017 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgcggttcgacagcgacgccgcgagtccgagaggggagccgcgggcgccgtgggtggagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1598 - DNA, 546 bp, Homo sapiens
gctcccactccatgaggtatttccacacctccgtgtcccggcccggccgcggggagccccgcttcatcgcagtgggctacgtggacgacacgcagttcgtgcggttcgacagcgacgccgcgagtccgagaggggagccgcgggcgccgtgggtggagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcgg

SEQ ID NO: 1599 - DNA, 1017 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1600 - DNA, 1017 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1601 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagtgagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1602 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcgg

SEQ ID NO: 1603 - DNA, 1017 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggcgtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1604 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccgcgagtccgagaggggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcgg

SEQ ID NO: 1605 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagaggatgtacggctgcgacgtggggccggacgggcgcctcctccgcgggcataaccagtacgcctacgacggcaaggattacatcgccctgaacgaggacctgcgctcctggaccgccgcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1606 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgaggcggagcagcggagagcctacctggagggcgagtgcgtggagtggctccgcagatacctggagaacgggaaggagacgctgcagcgcgcgg

SEQ ID NO: 1607 - DNA, 546 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcgg

SEQ ID NO: 1608 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagatgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1609 - DNA, 1017 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagaacctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1610 - DNA, 1017 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1611 - DNA, 1017 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagaggatgtacggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1612 - DNA, 1017 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagaggatgtacggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgaggcggagcagtggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1613 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagaggatgtacggctgcgacgtggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1614 - DNA, 546 bp, Homo sapiens
gctcccactccatgaggtatttctacaccgccatgtcccggcccggccgcggggagccccgcttcattgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1615 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatctacaaggcccaggcacagactgaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1616 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagaacctgcgcaccgcgctccgctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1617 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccgggagacacagaagtacaagggccaggcacagactgaccgagagagcctgcggaacctgcgcggctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1618 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1619 - DNA, 546 bp, Homo sapiens
gctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagaggatgtacggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcgg

SEQ ID NO: 1620 - DNA, 895 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacatcatccagaggatgtatggctgcgacctggggcccgacgggcgcctcctccgcgggcatgaccagttcgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1621 - DNA, 1017 bp, Homo sapiens
atgcgggtcacggcaccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccaggtgatgtatggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccaaagcccctcaccctgagatgggagccatcttcccaatccaccgtccccatcgtgggcattgttgctggcctggctgtcctagcagttgtggtcatcggagctgtggtcgctgctgtgatgtgtaggaggaagagctcaggtgga

SEQ ID NO: 1622 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccaggtgatgtatggctgcgacgtggggccggacgggcgcctcctccgcgggcatgaccagtctgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1623 - DNA, 1017 bp, Homo sapiens
atgcgggtcacggcaccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccaggtgatgtatggctgcgacgtggggccggacgggcgcctcctccgcgggcataaccagtacgcctacgacggcaaggattacatcgccctgaacgaggacctgagctcctggaccgcggcggacacggcggctcagatcacccagcgcaagtgggaggcggcccgtgtggcggagcagcggagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccaaagcccctcaccctgagatgggagccatcttcccaatccaccgtccccatcgtgggcattgttgctggcctggctgtcctagcagttgtggtcatcggagctgtggtcgctgctgtgatgtgtaggaggaagagctcaggtgga

SEQ ID NO: 1624 - DNA, 1017 bp, Homo sapiens
atgcgggtcacggcaccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccaggtgatgtatggctgcgacgtggggccggacgggcgcctcctccgcgggcataaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccaaagcccctcaccctgagatgggagccatcttcccaatccaccgtccccatcgtgggcattgttgctggcctggctgtcctagcagttgtggtcatcggagctgtggtcgctgctgtgatgtgtaggaggaagagctcaggtgga

SEQ ID NO: 1625 - DNA, 822 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccaggtgatgtatggctgcgacgtggggccggacgggcgcctcctccgcgggcataaccagtacgcctacgacggcaaggattacatcgccctgaacgaggacctgagctcctggaccgcggcggacacagcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtgcagcatgaggggctgccaaagcccctcaccctgagatggg

SEQ ID NO: 1626 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccaggtgatgtatggctgcgacgtggggccggacgggcgcctcctccgcgggtatgaccaggacgcctacgacggcaaggattacatcgccctgaacgaggacctgagctcctggaccgcggcggacacggcggctcagatcacccagcgcaagtgggaggcggcccgtgtggcggagcagcggagagcctacctggagggcctgtgcgtggagtggctccgcagatacctggagaacgggaaggagacgctgcagcgcgcgg

SEQ ID NO: 1627 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccagaggatgtatggctgcgacctggggcccgacgggcgcctcctccgcgggtataaccagtacgcctacgacggcaaggattacatcgccctgaacgaggacctgagctcctggaccgcggcggacacggcggctcagatcacccagcgcaagtgggaggcggcccgtgtggcggagcagcggagagcctacctggagggcctgtgcgtggagtggctccgcagatacctggagaacgggaaggagacgctgcagcgcgcgg

SEQ ID NO: 1628 - DNA, 1017 bp, Homo sapiens
atgcgggtcacggcaccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccaggtgatgtatggctgcgacgtggggccggacgggcgcctcctccgcgggcatgaccagtccgcctacgacggcaaggattacatcgccctgaacgaggacctgagctcctggaccgcggcggacacggcggctcagatcatccagcgcaagtgggaggcggcccgtgtggcggagcagctgagagcctacctggagggcctgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccaaagcccctcaccctgagatgggagccatcttcccaatccaccgtccccatcgtgggcattgttgctggcctggctgtcctagcagttgtggtcatcggagctgtggtcgctgctgtgatgtgtaggaggaagagctcaggtgga

SEQ ID NO: 1629 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccaggtgatgtatggctgcgacgtggggccggacgggcgcctcctccgcgggcataaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtcgctccgcagatacctggagaacgggaaggagacgctgcagcgcgcgg

SEQ ID NO: 1630 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctcccctactacaaccagagcgaggccgggtctcacatcatccaggtgatgtatggctgcgacgtggggccggacgggcgcctcctccgcgggcatgaccagtccgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1631 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggatggcgccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccaggtgatgtatggctgcgacgtggggccggacgggcgcctcctccgcgggcataaccagtacgcctacgacggcaaggattacatcgccctgaacgaggacctgagctcctggaccgcggcggacacggcggctcagatcacccagcgcaagtgggaggcggcccgtgaggcggagcaggacagagcctacctggagggcctgtgcgtggagtggctccgcagatacctggagaacgggaaggagacgctgcagcgcgcgg

SEQ ID NO: 1632 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1633 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggacggggagacacggaacatgaaggcctccgcgcagacttaccgagagaacctgcggatcgcgctccgctactacaaccagagcgaggccgggtctcacaccctccagtggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1634 - DNA, 619 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggacgaggagacacggaacatgaaggcctccgcgcagacttaccgagagaacctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgg

SEQ ID NO: 1635 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggacggggagacacggaacatgaaggcctccgcgcagacttaccgagagaacctgcggatcgcgctccgctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcgg

SEQ ID NO: 1636 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggacggggagacacggaacatgaaggcctccgcgcagacttaccgagagaacctgcggatcgcgctccgctactacaaccagagcgaggccgggtctcacaccctccagtggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagatacctggagaacgggaaggagacgctgcagcgcgcgg

SEQ ID NO: 1637 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggacggggagacacggaacatgaaggcctccgcgcagacttaccgagagaacctgcggatcgcgctccgctactacaaccagagcgaggccgggtctcacaccctccagtggatgtatggctgcgacctggggcccgacgggcgcctcctccgcgggcatgaccagtccgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtcgctccgcagatacctggagaacgggaaggagacgctgcagcgcgcgg

SEQ ID NO: 1638 - DNA, 1017 bp, Homo sapiens
atgcgggtcacggcaccccgaaccctcctcctgctgctctggggggccctggccctgaccgagacctgggccggctcccactccatgaggtatttctacaccgccatgtcccggcccggccgcggggagccccgcttcatcgcagtgggctacgtggacgacacgcagttcgtgaggttcgacagcgacgccgcgagtccgagagaggagccgcgggcgccgtggatagagcaggaggggccggagtattgggaccggaacacacagatcttcaagaccaacacacagacttaccgagagaacctgcggatcgcgctccgctactacaaccagagcgaggccgggtctcacacttggcagacgatgtatggctgcgacctggggccggacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcagctgagagcctacctggagggcacgtgcgtggagtggctccgcagatacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1639 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctacaaggcccaggcacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1640 - DNA, 541 bp, Homo sapiens
gctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcg

SEQ ID NO: 1641 - DNA, 1017 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccaagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtgga

SEQ ID NO: 1642 - DNA, 1020 bp, Homo sapiens
atgctggtcatggcgccccgaaccgtcctcctgctgctctcggcggccctggccctgaccgagacctgggccggctcccactccatgaggtatttccacacctccgtgtcccggcctggccgcggggagccccgcttcatcaccgtgggctacgtggacgacacccagttcgtgaggttcgacagcgacgccgcgagtccgagagaggagccgcgggcgccgtggatagagcaggaggggccggagtattgggaccggaacacacagatctgcaaggccaaggcacagactgaccgagtgggcctgcggaacctgcgcggctactacaaccagagcgaggacgggtctcacacttggcagacgatgtatggctgcgacatggggccggacgggcgcctcctccgcgggtataaccagttcgcctacgacggcaaggattacatcgccctgaacgaggacctgcgctcctggaccgccgcggacacggcggctcagatcacccagcgcaagtgggaggcggcccgtgtggcggagcagctgagagcctacctggagggcgagtgcgtggagtggctccgcagacacctggagaacgggaaggagacgctgcagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggacaagaacagagatacacgtgccatgtgcagcacgaggggctgcaggagccctgcaccctgagatggaagccatcttcccagtccaccatccccatcgtgggcattgttgctggcctggctgtccttgtggtcaccgtagctgtggtcgctgtggtcgctgctgtgatgtgtaggaggaagagctcaggtgga

SEQ ID NO: 1643 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagactgaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1644 - DNA, 1017 bp, Homo sapiens
atgcgggtcacggcgccccgaaccgtcctcctgctgctctggggggcagtggccctgaccgagacctgggccggctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggtcgctactgtgatgtgtaggaggaagagctcaggtgga

SEQ ID NO: 1645 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1646 - DNA, 546 bp, Homo sapiens
gctcccactccatgaggtatttctacaccgccatgtcccggcccggccgcggggagccccgcttcattgcagtgggctacgtggacgacacccagttcgtgaggttcgacagcgacgccgcgagtccgaggacggagccccgggcgccatggatagagcaggaggggccggagtattgggaccggaacacacagatctgcaagaccaacacacagactgaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1647 - DNA, 822 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccggaacacacagatcttcaagaccaacacacagacttaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggg

SEQ ID NO: 1648 - DNA, 546 bp, Homo sapiens
gctcccactccatgaggtatttctacaccgccatgtcccggcccggccgcggggagccccgcttcatcgcagtgggctacgtggacgacacccagttcgtgaggttcgacagcgacgccgcgagtccgaggacggagccccgggcgccatggatagagcaggaggggccggagtattgggaccgggagacacagatctccaagaccaacacacagacttaccgagagagcctgcggaacctgcgcggctactacaaccagagcgaggccgggtctcacacttggcagacgatgtatggctgcgacgtggggccggacgggcgcctcctccgcgggcataaccagtacgcctacgacggcaaagattacatcgccctgaacgaggacctgagctcctggaccgcggcggacaccgcggctcagatcacccagcgcaagtgggaggcggcccgtgaggcggagcagctgagagcctacctggagggcctgtgcgtggagtggctccgcagacacctggagaacgggaaggagacgctgcagcgcgcgg

SEQ ID NO: 1649 - DNA, 1017 bp, Homo sapiens
atgctggtcatggcgccccgaaccgtcctcctgctgctctggggggcagtggccctgaccgagacctgggccggctcccactccatgaggtatttctacacctccgtgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgccgcggacacggcggctcagatctcccagcgcaagttggaggcggcccgtgtggcggagcagctgagagcctacctggagggcgagtgcgtggagtggctccgcagatacctggagaacgggaaggacaagctggagcgcgctgaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtggacagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagttctggtgga

SEQ ID NO: 1650 - DNA, 546 bp, Homo sapiens
gctcccactccatgaggtatttctacaccgctatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagaggatgtttggctgcgacctggggcccgacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcaggacagagcctacctggaggacctgtgcgtggagtcgctccgcagatacctggagaacgggaaggagacgctgcagcgcgcgg

SEQ ID NO: 1651 - DNA, 1017 bp, Homo sapiens
atgcgggtcacggcaccccgaaccctcctcctgctgctctggggggccctggccctgaccgagacctgggctggctcccactccatgaggtatttctacaccgctatgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacaccctccagaggatgtttggctgcgacctggggcccgacgggcgcctcctccgcgggcataaccagttagcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagaagtgggcagctgtggtggtgccttctggagaagagcagagatacacatgccatgtacagcatgaggggctgccgaagcccctcaccctgagatgggagccatcttcccagtccaccatccccatcgtgggcattgttgctggcctggctgtcctagcagttgtggtcatcggagctgtggttgctactgtgatgtgtaggaggaagagctcaggtgga

SEQ ID NO: 1652 - DNA, 620 bp, Homo sapiens
atgcgggtcacggcgccccgaaccctcctcctgctgctctggggggcagtggccctgaccgagacctgggccggctcccactccatgaggtatttctacaccgccatgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatctacaaggcccaggcacagactgaccgagagagcctgcggaacctgcgcggctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggb

SEQ ID NO: 1653 - DNA, 1094 bp, Homo sapiens
atgcgggtcatggcgccccgaaccctcatcctgctgctctcgggagccctggccctgaccgagacctgggcctgctcccactccatgaagtatttcttcacatccgtgtcccggcctggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtgtggctgcgacctggggcccgacgggcgcctcctccgcgggtatgaccagtacgcctacgacggcaaggattacatcgccctgaacgaggacctgcgctcctggaccgccgcggacaccgcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtgatggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1654 - DNA, 1094 bp, Homo sapiens
atgcgggtcatggcgccccgaaccctcatcctgctgctctcgggagccctggccctgaccgagacctgggcctgctcccactccatgaagtatttcttcacatccgtgtcccggcctggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtgtggctgcgacctggggcccgacgggcgcctcctccgcgggtataaccagttcgcctacgacggcaaggattacatcgccctgaacgaggacctgcgctcctggaccgccgcggacaccgcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtgatggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1655 - DNA, 1094 bp, Homo sapiens
atgcgggtcatggcgccccgaaccctcatcctgctgctctcgggagccctggccctgaccgagacctgggcctgctcccactccatgaagtatttcttcacatccgtgtcccggcctggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtgtggctgcgacctggggcccgacgggcgcctcctccgcgggtatgaccagtccgcctacgacggcaaggattacatcgccctgaacgaggacctgcgctcctggaccgctgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1656 - DNA, 546 bp, Homo sapiens
gctcccactccatgaagtatttcttcacatccgtgtcccggcctggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtctggctgcgacctggggcccgacgggcgcctcctccgcgggtatgaccagtacgcctacgacggcaaggattacatcgccctgaacgaggacctgcgctcctggaccgccgcggacaccgcggctcagatcacccagcgcaagtgggaggcggcccgtgaggcggagcagcggagagcctacctggagggcacgtgcgtggagtggctccgcagatacctggagaacgggaaggagacgctgcagcgcgcgg

SEQ ID NO: 1657 - DNA, 546 bp, Homo sapiens
gctcccactccatgaagtatttcttcacatccgtgtcccggcctggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtgtggctgcgacctggggcccgacgggcgcctcctccgcgggtatgaccagtacgcctacgacggcaaggattacatcgccctgaacgaggacctgcgctcctggaccgccgcggacaccgcggctcagatcacccagcgcaagtgggaggcggcccgtgtggcggagcagcggagagcctacctggagggcacgtgcgtggagtggctccgcagatacctggagaacgggaaggagacgctgcagcgcgcgg

SEQ ID NO: 1658 - DNA, 546 bp, Homo sapiens
gctcccactccatgaagtatttcttcacatccgtgtcccggcctggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtgtggctgcgacctggggcccgacgggcgcctcctccgcaggtatgaccagtacgcctacgacggcaaggattacatcgccctgaacgaggacctgcgctcctggaccgccgcggacaccgcggctcagatcacccagcgcaagtgggaggcggcccgtgaggcggagcagcggagagcctacctggagggcacgtgcgtggagtggctccgcagatacctggagaacgggaaggagacgctgcagcgcgcgg

SEQ ID NO: 1659 - DNA, 546 bp, Homo sapiens
gctcccactccatgaagtatttcttcacatccgtgtcccggcctggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtgtggctgcgacctggggcccgacgggcgcctcctccgcgggtatgaccagtacgcctacgacggcaaggattacatcgccctgaacgaggacctgcgctcctggaccgccgcggacaccgcggctcagatcacccagcgcaagtgggaggcggcctgtgaggcggagcagcggagagcctacctggagggcacgtgcgtggagtggctccgcagatacctggagaacgggaaggagacgctgcagcgcgcgg

SEQ ID NO: 1660 - DNA, 546 bp, Homo sapiens
gctcccactccatgaagtatttcttcacatccgtgtcccggcctggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtgtggctgcgacctggggcccgacgggcgcctcctccgcgggtatgaccagtacgcctacgacggcaaggattacatcgccctgaacgaggacctgcgctcctggaccgccgcggacaccgcggctcagatcacccagcgcaagtgggaggcggcccgtgaggcggagcagtggagagcctacctggagggcacgtgcgtggagtggctccgcagatacctggagaacgggaaggagacgctgcagcgcgcgg

SEQ ID NO: 1661 - DNA, 1094 bp, Homo sapiens
atgcgggtcatggcgccccgaaccctcctcctgctgctctcgggagccctggccctgaccgagacctgggcctgctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactacgcggctactacaaccagagcgaggccgggtctcacaccctccagaggatgtacggctgcgacctggggcccgacgggcgcctcctccgcgggtatgaccagtccgcctacgacggcaaggattacatcgccctgaacgaggacctgcgctcctggaccgccgcggacacagcggctcagatcacccagcgcaagtgggaggcggcccgtgaggcggagcagtggagagcctacctggagggcgagtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctacggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1662 - DNA, 1094 bp, Homo sapiens
atgcgggtcatggcgccccgaaccctcctcctgctgctctcgggagccctggccctgaccgagacctgggcctgctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtacggctgcgacctggggcccgacgggcgcctcctccgcgggtatgaccagtccgcctacgacggcaaggattacatcgccctgaacgaggacctgcgctcctggaccgccgcggacacagcggctcagatcacccagcgcaagtgggaggcggcccgtgaggcggagcagtggagagcctacctggagggcgagtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctacggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1663 - DNA, 546 bp, Homo sapiens
gctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacacagcggctcagatcacccagcgcaagtgggaggcggcccgtgaggcggagcagtggagagcctacctggagggcgagtgcgtggagtggctccgcagatacctggagaacgggaaggagacgctgcagcgcgcgg

SEQ ID NO: 1664 - DNA, 1015 bp, Homo sapiens
atgcgggtcatggcgccccgaaccctcctcctgctgctctcgggagccctggccctgaccgagacctgggcctgctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtacggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcgagtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcag

SEQ ID NO: 1665 - DNA, 546 bp, Homo sapiens
gctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcgagtgcgtggagtggctccgcagatacctggagaacgggaaggagacgctgcagcgcgcgg

SEQ ID NO: 1666 - DNA, 546 bp, Homo sapiens
gctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtacggctgcgacctggggcccgacgggcgcctcctccgcgggtatgaccagtccgcctacgacggcaaggattacatcgccctgaacgaggacctgcgctcctggaccgccgcggacacagcggctcagatcacccagcgcaagtgggaggcggcccgtgtggcggagcagctgagagcctacctggagggcgagtgcgtggagtggctccgcagatacctggagaacgggaaggagacgctgcagcgcgcgg

SEQ ID NO: 1667 - DNA, 546 bp, Homo sapiens
gctcccactccatgaggtgtttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtacggctgcgacctggggcccgacgggcgcctcctccgcgggtatgaccagtccgcctacgacggcaaggattacatcgccctgaacgaggacctgcgctcctggaccgccgcggacacagcggctcagatcacccagcgcaagtgggaggcggcccgtgaggcggagcagtggagagcctacctggagggcgagtgcgtggagtggctccgcagatacctggagaacgggaaggagacgctgcagcgcgcgg

SEQ ID NO: 1668 - DNA, 546 bp, Homo sapiens
gctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcgagtgcgtggagtggctccgcagatacctggagaacgggaaggagacgctgcagcgcgcgg

SEQ ID NO: 1669 - DNA, 546 bp, Homo sapiens
gctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtacggctgcgacctggggcccgacgggcgcctcctccgcgggcatgaccagttagcctacgacggcaaggattacatcgccctgaacgaggacctgcgctcctggaccgccgcggacacggcggctcagatcacccagcgcaagtgggaggcggcccgtgaggcggagcagtggagagcctacctggagggcgagtgcgtggagtggctccgcagatacctggagaacgggaaggagacgctgcagcgcgcgg

SEQ ID NO: 1670 - DNA, 1094 bp, Homo sapiens
atgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcctccagaggatgtatggctgcgacgtggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1671 - DNA, 1094 bp, Homo sapiens
atgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcctccagaggatgtatggctgcgacgtggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1672 - DNA, 1094 bp, Homo sapiens
atgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccaggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1673 - DNA, 1094 bp, Homo sapiens
atgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccaggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggcccagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1674 - DNA, 546 bp, Homo sapiens
gctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccaggtctcacatcatccagaggatgtatggctgcgacgtgggacccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcgg

SEQ ID NO: 1675 - DNA, 1094 bp, Homo sapiens
atgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1676 - DNA, 546 bp, Homo sapiens
gctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtacggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcgg

SEQ ID NO: 1677 - DNA, 546 bp, Homo sapiens
gctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagagcatgtacggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcgg

SEQ ID NO: 1678 - DNA, 546 bp, Homo sapiens
gctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgtccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcgg

SEQ ID NO: 1679 - DNA, 546 bp, Homo sapiens
gctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcgg

SEQ ID NO: 1680 - DNA, 1015 bp, Homo sapiens
atgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcag

SEQ ID NO: 1681 - DNA, 546 bp, Homo sapiens
gctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacctggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcgg

SEQ ID NO: 1682 - DNA, 546 bp, Homo sapiens
gctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaaactgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcgg

SEQ ID NO: 1683 - DNA, 546 bp, Homo sapiens
gctcccactccatgaggtatttctacaccgctgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccaggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcgg

SEQ ID NO: 1684 - DNA, 546 bp, Homo sapiens
gctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccaggtctcacatcatccagaggatgtatggctgcgacgtggggcccgacgggcgcctcctccgcgggtatgaccagttagcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcgg

SEQ ID NO: 1685 - DNA, 1094 bp, Homo sapiens
atgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccaggtctcacaccctccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1686 - DNA, 546 bp, Homo sapiens
gctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctgaagaatgggaaggagacgctgcagcgcgcgg

SEQ ID NO: 1687 - DNA, 546 bp, Homo sapiens
gctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgaacctgcggaaactgcgcggctactacaaccagagcgaggacgggtctcacatcctccagaggatgtatggctgcgacgtggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcgg

SEQ ID NO: 1688 - DNA, 546 bp, Homo sapiens
gctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcctccagaggatgtatggctgcgacgtggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1689 - DNA, 1094 bp, Homo sapiens
atgcgggtcatggcgccccgaaccctcatcctgctgctctcgggagccctggccctgaccgagacctgggccggctcccactccatgaggtatttctccacatccgtgtcctggcccggccgcggggagccccgcttcatcgcagtgggctacgtggacgacacgcagttcgtgcggttcgacagcgacgccgcgagtccaagaggggagccgcgggagccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtggtggtgccttctggagaagagcagagatacacgtgccatgttcagcacgaggggctgccggagcccctcaccctgagatggaagccgtcttcccagcccaccatccccatcgtgggcatcgttgctggcctggctgtcctggctgtcctagctgtcctaggagctatggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1690 - DNA, 546 bp, Homo sapiens
gctcccactccatgaggtatttctccacatccgtgtcctggcccggccgcggggagccccgcttcatcgcagtgggctacgtggacgacacacagttcgtgcggttcgacagcgacgccgcgagtccaagaggggagccgcgggagccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcgg

SEQ ID NO: 1691 - DNA, 1094 bp, Homo sapiens
atgcgggtcatggcgccccgaaccctcatcctgctgctctcgggagccctggccctgaccgagacctgggccggctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtggtggtgccttctggagaagagcagagatacacgtgccatgttcagcacgaggggctgccggagcccctcaccctgagatggaagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1692 - DNA, 546 bp, Homo sapiens
gctcccactccatgaggtatttctccacatccgtgtcctggcccggccgcggggagccccgcttcatcgcagtgggctacgtggacgacacgcagttcgtgcggttcgacagcgacgccgcgagtccaagaggggagccgcgggagccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1693 - DNA, 546 bp, Homo sapiens
gctcccactccatgaggtatttctccacatccgtgtcctggcccggccgcggggagccccgcttcatcgcagtgggctacctggacgacacgcagttcgtgcggttcgacagcgacgccgcgagtccaagaggggagccgcgggagccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcgg

SEQ ID NO: 1694 - DNA, 546 bp, Homo sapiens
gctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1695 - DNA, 546 bp, Homo sapiens
gctcccactccatgaggtatttctccacatccgtgtcctggcccggccgcggggagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcgg

SEQ ID NO: 1696 - DNA, 546 bp, Homo sapiens
gctcccactccatgaggtatttctccacatccgtgtcctggcccggccgcggggagccccgcttcatcgcagtgggctacgtggacgacacgcagttcgtgcggttcgacagcgacgccgcgagtccaagaggggagccgcgggagccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcctgtgcgtggagtggctccgcagatacctggagaacgggaaggagacgctgcagcgcgcgg

SEQ ID NO: 1697 - DNA, 546 bp, Homo sapiens
gctcccactccatgaggtatttctccacatccgtgtcctggcccggccgcggggagccccgcttcatcgcagtgggctacgtggacgacacgcagttcgtgcggttcgacagcgacgccgcgagtccaagaggggagccgcgggagccgtgggtggagcaggaggggccggagtattgggaccgggagacacagaagtacaagcgccaggcacagactgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcgg

SEQ ID NO: 1698 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1699 - DNA, 546 bp, Homo sapiens
gctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcatgtgcgtggagtggctgcgcagatacctggagaacgggaaggagacgctgcagcgcgcgg

SEQ ID NO: 1700 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaccccccaaagacacatgtgacccaccaccccatctctgaccatgaggtcaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1701 - DNA, 546 bp, Homo sapiens
gctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtatgaccagtccgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcgg

SEQ ID NO: 1702 - DNA, 546 bp, Homo sapiens
gctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacgtggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcgg

SEQ ID NO: 1703 - DNA, 546 bp, Homo sapiens
gctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgcggtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcgg

SEQ ID NO: 1704 - DNA, 1094 bp, Homo sapiens
atgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1705 - DNA, 546 bp, Homo sapiens
gctcccactccatgaggtatttctacaccgctgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcgg

SEQ ID NO: 1706 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1707 - DNA, 546 bp, Homo sapiens
gctcccactccatgaggtatttcgacaccgccgtgtcccggcccggccgcggagagccccgcttcatctcagtgggctacgtggacgacacgcagttcgtgcagttcgacagcgacgccgcgagtccaagaggggagccccgggcgccgtgggtggagcaggaggggccggagtattgggaccgggagacacagaagtacaagcgccaggcacagactgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcgg

SEQ ID NO: 1708 - DNA, 942 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcag

SEQ ID NO: 1709 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagaaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcgg

SEQ ID NO: 1710 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcgagtgcgtggagtggctccgcagatacctggagaacgggaaggagacgctgcagcgcgcgg

SEQ ID NO: 1711 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtataaccagttcgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcgg

SEQ ID NO: 1712 - DNA, 1094 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaa

SEQ ID NO: 1713 - DNA, 1094 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcctaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaa

SEQ ID NO: 1714 - DNA, 1094 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaa

SEQ ID NO: 1715 - DNA, 1022 bp, Homo sapiens
tgctcccactccatgaggtatttcgacaccgccgtgtcccggcccggcgccggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgcggcggacaccgcggctcagatcacccagcgcaagtgggaggcggcccgtgcggcggagcagctgagagcctacctggagggactgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaa

SEQ ID NO: 1716 - DNA, 1094 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccttccagaggatgtatggctgcgacctggggcccgacgggcgcctcctccgcgggtatgaccagttcgcctacgacggcaaggattacatcgccctgaacgaggacctgcgctcctggaccgccgcggacaccgcggctcagatcacccagcgcaagttggaggcggcccgtgcggcggagcaggacagagcctacctggagggcacgtgcgtggagtggctccgcagatacctggagaacgggaagaagacgctgcagcgcgcggaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaa

SEQ ID NO: 1717 - DNA, 1094 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgagcctgcggaacctgcgcggctactataaccagagcgaggacgggtctcacaccttccagaggatgtatggctgcgacctggggcccgacgggcgcctcctccgcgggtatgaccagttcgcctacgacggcaaggattacatcgccctgaacgaggacctgcgctcctggaccgccgcggacaccgcggctcagatcacccagcgcaagttggaggcggcccgtgcggcggagcaggacagagcctacctggagggcacgtgcgtggagtggctccgcagatacctggagaacgggaagaagacgctgcagcgcgcggaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaa

SEQ ID NO: 1718 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaatatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcag

SEQ ID NO: 1719 - DNA, 1094 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctaagatgtgtaggaggaagagctcaggtggaaaaggagggagctgctctcaggttgcgtgcagcaacagtgcccagggctctgatgagtctctcatcacttgtaa

SEQ ID NO: 1720 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgaacctgcggaaactgcgcggctactacaaccagagcgaggccgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcag

SEQ ID NO: 1721 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtttggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcag

SEQ ID NO: 1722 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgaacctgcggaaactgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcag

SEQ ID NO: 1723 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacatcatccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcag

SEQ ID NO: 1724 - DNA, 1094 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccttccagaggatgtatggctgcgacctggggcccgacgggcgcctcctccgcgggtatgaccagttcgcctacgacggcaaggattacatcgccctgaacgaggacctgcgctcctggaccgccgcggacaccgcggctcagatcacccagcgcaagttggaggcggcccgtgcggcggagcaggacagagcctacctggagggcacgtgcgtggagtggctccgcagatacctggagaacgggaagaagacgctgcagcgcgcggaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcgcttgtaa

SEQ ID NO: 1725 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccttccagaggatgtatggctgcgacctggggcccgacgggcgcctcctccgcgggtatgaccagttcgcctacgacggcaaggattacatcgccctgaacgaggacctgcgctcctggaccgccgcggacaccgcggctcagatcacccagcgcaagtgggaggcggcccgtgcggcggagcaggacagagcctacctggagggcacgtgcgtggagtggctccgcagatacctggagaacgggaagaagacgctgcagcgcgcgg

SEQ ID NO: 1726 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagttcgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcag

SEQ ID NO: 1727 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtacggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcacag

SEQ ID NO: 1728 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcgagtgcgtggagtggctccgcagatacctggagaacgggaaggagacgctgcagcgcgcag

SEQ ID NO: 1729 - DNA, 546 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggccgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcag

SEQ ID NO: 1730 - DNA, 822 bp, Homo sapiens
gctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagtgggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctggg

SEQ ID NO: 1731 - DNA, 1094 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggttgcgtgcagcaacagtgcccagggctctgatgagtctctcatcacttgtaa

SEQ ID NO: 1732 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacacggcggctcagatcacccagcgcaagtgggaggcggcccgtacggcggagcagctgagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1733 - DNA, 546 bp, Homo sapiens
gctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtacggctgcgacctggggcccgacgggcgcctcctccgcgggtataaccagttcgcctacgacggcaaggattacatcgccctgaatgaggacctgcgctcctggaccgccgcggacacggcggctcagatcacccagcgcaagtgggaggcggcccgtacggcggagcagctgagagcctacctggagggcacgtgcgtggagtggctccgcagatacctggagaacgggaagaagacgctgcagcgcgcgg

SEQ ID NO: 1734 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1735 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacacggcggctcagatcacccagcgcaagtgggaggcggcccgtacggcggagcagctgagagcctacctggagggcacgtgcgtggagtggctccgcagatacctggagaacaggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1736 - DNA, 546 bp, Homo sapiens
gctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagctgagagcctacctggagggcacgtgcgtggagtggctccgcagatacctggagaacgggaagaagacgctgcagcgcgcgg

SEQ ID NO: 1737 - DNA, 546 bp, Homo sapiens
gctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcgg

SEQ ID NO: 1738 - DNA, 546 bp, Homo sapiens
gctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacacggcggctcagatcacccagcgcaagtgggaggcggcccgtacggcggagcagctgagagcctacctggagggcgcgtgcgtggagtggctccgcagatacctggagaacaggaagaagacgctgcagcgcgcgg

SEQ ID NO: 1739 - DNA, 546 bp, Homo sapiens
gctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagttggaggcggcccgtgaggcggagcagcggagagcctacctggagggcacgtgcgtggagtggctccgcagatacctggagaacgggaagaagacgctgcagcgcgcgg

SEQ ID NO: 1740 - DNA, 546 bp, Homo sapiens
gctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagagcatgtatggctgcgacctggggcccgacgggcgcctcctccgcgggtataaccagttcgcctacgacggcaaggattacatcgccctgaatgaggacctgcgctcctggaccgccgcggacacggcggctcagatcacccagcgcaagtgggaggcggcccgtacggcggagcagctgagagcctacctggagggcacgtgcgtggagtggctccgcagatacctggagaacgggaagaagacgctgcagcgcgcgg

SEQ ID NO: 1741 - DNA, 687 bp, Homo sapiens
atgcgggtcatggcgccccgaaccctcaccctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagaggatgtatggctgcgacctggggcccgacgggcgcctcctccgcgggtatgaccagtccgcctacgacggcaaggattacatcgccctgaatgaggacctgcgctcctggaccgccgcggacacggcggctcagatcacccagcgcaagtgggaggcggcccgtacggcggagcagctgagagcctacctggagggcacgtgcgtggagtggctccgcagatacctggagaacggggagaagacgctgcagcgcgcggaacacccaaagacacacgtgacccaccatcccgtctctgaccatgaggccaccctgaggtgctgggcc

SEQ ID NO: 1742 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggccgggtctcacaccctccagaggatgtacggctgcgacctggggcccgacgggcgcctcctccgcgggtatgaccagtccgcctacgacggcaaggattacatcgccctgaacgaggacctgcgctcctggaccgctgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1743 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggccgggtctcacaccctccagaggatgtacggctgcgacctggggcccgacgggcgcctcctccgcgggtatgaccagtccgcctacgacggcaaggattacatcgccctgaacgaggacctgcgctcctggaccgctgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1744 - DNA, 546 bp, Homo sapiens
gctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggccgggtctcacaccctccagaggatgtatggctgcgacctggggcccgacgggcgcctcctccgcgggtatgaccagtccgcctacgacggcaaggattacatcgccctgaacgaggacctgcgctcctggaccgctgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcgg

SEQ ID NO: 1745 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggactgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1746 - DNA, 546 bp, Homo sapiens
gctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgcggcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcgg

SEQ ID NO: 1747 - DNA, 681 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgaacctgcggaaactgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgc

SEQ ID NO: 1748 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgaacctgcggaaactgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggactgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1749 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggactgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1750 - DNA, 546 bp, Homo sapiens
gctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacgtcaaggattacatcgccctgaacgaggacctgcgctcctggactgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcgg

SEQ ID NO: 1751 - DNA, 546 bp, Homo sapiens
gctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacaggctgaccgagtgggcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggactgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcgg

SEQ ID NO: 1752 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacaggctgaccgagtgagcctgcggaacctgcgcggctactacaaccagagcgaggccgggtctcacaccctccagaggatgtacggctgcgacctggggcccgacgggcgcctcctccgcgggtatgaccagtccgcctacgacggcaaggattacatcgccctgaacgaggacctgcgctcctggaccgctgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1753 - DNA, 1094 bp, Homo sapiens
atgcgggtcatggcgccccgaaccctcatcctgctgctctcgggagccctggccctgaccgagacctgggcctgctcccactccatgaggtatttctccacatccgtgtcccggcccggccgcggggagccccgcttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtttggctgcgacctggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1754 - DNA, 546 bp, Homo sapiens
gctcccactccatgaggtatttctccacatccgtgtcccggcccggccgcggggagccccgcttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtttggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcgg

SEQ ID NO: 1755 - DNA, 1094 bp, Homo sapiens
atgcgggtcatggcgccccgaaccctcatcctgctgctctcgggagccctggccctgaccgagacctgggcctgctcccactccatgaggtatttctccacatccgtgtcccggcccggccgcggggagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtttggctgcgacctggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1756 - DNA, 546 bp, Homo sapiens
gctcccactccatgaggtatttctccacatccgtgtcccggcccggccgcggggagccccgcttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgaacctgcggaacctgcgcggctactacaaccagagcgaggccgggtctcacaccctccagtggatgtttggctgcgacctggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcgg

SEQ ID NO: 1757 - DNA, 546 bp, Homo sapiens
gctcccactccatgaggtatttctccacatccgtgtcccggcccggccgcggggagccccgcttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcgg

SEQ ID NO: 1758 - DNA, 1094 bp, Homo sapiens
atgcgggtcatggcgccccgaaccctcctcctgctgctctcgggagccctggccctgaccgagacctgggcctgctcccactccatgaggtatttctacaccgctgtgtcccggcccggccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacagactgaccgagtgaacctgcggaaactgcgcggctactacaaccagagcgaggccgggtctcacatcatccagaggatgtatggctgcgacctggggcccgacgggcgcctcctccgcgggcatgaccagttagcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1759 - DNA, 546 bp, Homo sapiens
gctcccattccatgaggtatttctacaccgctgtgtcccggcccggccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacagactgaccgagtgaacctgcggaaactgcgcggctactacaaccagagcgaggccgggtctcacatcatccagaggatgtatggctgcgacctggggcccgacgggcgcctcctccgcgggcatgaccagttagcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1760 - DNA, 1094 bp, Homo sapiens
atgcgggtcatggcgccccgaaccctcctcctgctgctctcgggagccctggccctgaccgagacctgggcctgctcccactccatgaggtatttctacaccgctgtgtcccggcccggccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacaggctgaccgagtgaacctgcggaaactgcgcggctactacaaccagagcgaggccgggtctcacatcatccagaggatgtatggctgcgacctggggcccgacgggcgcctcctccgcgggcatgaccagttagcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1761 - DNA, 1094 bp, Homo sapiens
atgcgggtcatggcgccccgaaccctcctcctgctgctctcgggagccctggccctgaccgagacctgggcctgctcccactccatgaggtatttctacaccgctgtgtcccggcccggccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacagactgaccgagtgaacctgcggaaactgcgcggctactacaaccagagcgaggccgggtctcacatcatccagaggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1762 - DNA, 1094 bp, Homo sapiens
atgcgggtcatggcgccccgaactctcctcctgctgctctcgggagccctggccctgaccgagacctgggcctgctcccactccatgaggtatttctacaccgctgtgtcccggcccggccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacagactgaccgagtgaacctgcggaaactgcgcggctactacaaccagagcgaggccgggtctcacatcatccagaggatgtatggctgcgacctggggcccgacgggcgcctcctccgcgggcatgaccagttcgcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1763 - DNA, 1094 bp, Homo sapiens
atgcgggtcatggcgccccgaaccctcctcctgctgctctcgggagccctggccctgaccgagacctgggcctgctcccactccatgaggtatttctacaccgctgtgtcccggcccggccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacagactgaccgagtgaacctgcggaaactgcgcggctactacaaccagagcgaggccgggtctcacatcatccagaggatgtatggctgcgacctggggcccgacgggcgcctcctccgcgggcatgaccagttcgcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaa

SEQ ID NO: 1764 - DNA, 1015 bp, Homo sapiens
atgcgggtcatggcgccccgaaccctcctcctgctgctctcgggagccctggccctgaccgagacctgggcctgctcccactccatgaggtatttctacaccgctgtgtcccggcccggccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacagactgaccgagtgaacctgcggaaactgcgcggctactacaaccagagcgaggccgggtctcacatcatccagaggatgtatggctgcgacctggggcccgacgggcgcctcctccgcgggcatgaccagtacgcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcag

SEQ ID NO: 1765 - DNA, 546 bp, Homo sapiens
gctcccactccatgaggtatttctacaccgctgtgtcccggcccggccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacagactgaccgagtgagcctgcggaacctgcgcggctactacaaccagagcgaggccgggtctcacatcatccagaggatgtatggctgcgacctggggcccgacgggcgcctcctccgcgggcatgaccagttagcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1766 - DNA, 546 bp, Homo sapiens
gctcccactccatgaggtatttctacaccgctgtgtcccggcccggccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacagactgaccgagtgaacctgcggaaactgcgcggctactacaaccagagcgaggccgggtctcacatcatccagaggatgtatggctgcgacctggggcccgacgggcgcctcctccgcgggcatgaccagttagcctacgacggcaaggattacatcgccctgaacgaggacctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcgg

SEQ ID NO: 1767 - DNA, 546 bp, Homo sapiens
gctcccactccatgaggtatttctacaccgctgtgtcccggcccggccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacagactgaccgagtgaacctgcggaaactgcgcggctactacaaccagagcgaggccgggtctcacatcatccagaggatgtatggctgcgacctggggcccgacgggcgcctcctccgcgggcatgaccagtccgcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1768 - DNA, 546 bp, Homo sapiens
gctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaactacaagcgccaggcacagactgaccgagtgaacctgcggaaactgcgcggctactacaaccagagcgaggccgggtctcacatcatccagaggatgtatggctgcgacctggggcccgacgggcgcctcctccgcgggcatgaccagttagcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1769 - DNA, 546 bp, Homo sapiens
gctcccactccatgaggtatttctacaccgctgtgtcccggcccagccgcggagagccccacttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacatcatccagaggatgtatggctgcgacctggggcccgacgggcgcctcctccgcgggcatgaccagttagcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggagaacgggaaggagacgctgcagcgcgcgg

SEQ ID NO: 1770 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcaggtggaaaaggagggagctgctctcaggctgcgtccagcaacagtgcccagggctctgatgagtctctcatcgcttgtaa

SEQ ID NO: 1771 - DNA, 1094 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcaggtggaaaaggagggagctgctctcaggctgcgtccagcaacagtgcccagggctctgatgagtctctcatcgcttgtaa

SEQ ID NO: 1772 - DNA, 1015 bp, Homo sapiens
atgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagtggagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcag

SEQ ID NO: 1773 - DNA, 1015 bp, Homo sapiens
atgcgggtcatggcgccccaagccctcctcctgctgctctcgggagccctggccctgatcgagacctgggccggctcccactccatgaggtatttctacaccgccgtgtcccggcccggccgcggagagccccgcttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgaacctgcggaaactgcgcggctactacaaccagagcgaggccggttctcacaccatccagaggatgtatggctgcgacctggggcccgacgggcgcctcctccgcgggtataaccagttcgcctacgacggcaaggattacatcgccctgaacgaggacctgcgctcctggaccgcggcggacacggcggctcagatctcccagcgcaagttggaggcggcccgtgaggcggagcagctgagagcctacctggagggcgagtgcgtggagtggctccgcggatacctggagaacgggaaggagacgctgcagcgcgcggaacgcccaaagacacacgtgacccaccatcccgtctctgaccatgaggccaccctgaggtgctgggccctgggcttctaccctgcggagatcacactgacctggcagcgggatggggaggaccaaactcaggacaccgagcttgtggagaccaggccagcaggagatggaaccttccagaagtgggcagctgtggtggtgccttctggacaagaacagagatacacgtgccatgtgcagcacgaggggctgcaggagccctgcaccctgagatggaagccgtcttcccagcccaccatccccaacttgggcatcgtttctggcccagctgtcctggctgtcctggctgtcctggctgtcctagctgtcctaggagctgtggtcgctgctgtgatac

SEQ ID NO: 1774 - DNA, 895 bp, Homo sapiens
atgcgggtcatggcgccccgaaccctcatcctgctgctctcgggagccctggccctgatcgagacctgggccggctcccactccatgaggtatttctacaccgccgtgtcccggcccggccgcggagagccccgcttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgaacctgcggaaactgcgcggctactacaaccagagcgaggccggttctcacaccatccagaggatgtatggctgcgacctggggcccgacgggcgcctcctccgcgggtataaccagttcgcctacgacggcaaggattacatcgccctgaacgaggacctgcgctcctggaccgcggcggacacggcggctcagatctcccagcgcaagttggaggcggcccgtgaggcggagcagctgagagcctacctggagggcgagtgcgtggagtggctccgcggatacctggagaacgggaaggagacgctgcagcgcgcggaacgcccaaagacacacgtgacccaccatcccgtctctgaccatgaggccaccctgaggtgctgggccctgggcttctaccctgcggagatcacactgacctggcagcgggatggggaggaccaaactcaggacaccgagcttgtggagaccaggccagcaggagatggaaccttccagaagtgggcagctgtggtggtgccttctggacaagaacagagatacacgtgccatgtgcagcacgaggggctgcaggagccctgcaccctgagatgga

SEQ ID NO: 1775 - DNA, 1014 bp, Homo sapiens
atgcgggtcatggcgccccaagccctcctcctgctgctctcgggagccctggccctgatcgagacctggaccggctcccactccatgaggtatttctacaccgccgtgtcccggcccggccgcggagagccccgcttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgaacctgcggaaactgcgcggctactacaaccagagcgaggccggttctcacaccatccagaggatgtatggctgcgacctggggcccgacgggcgcctcctccgcgggtataaccagttcgcctacgacggcaaggattacatcgccctgaacgaggacctgcgctcctggaccgcggcggacacggcggctcagatctccagcgcaagttggaggcggcccgtgaggcggagcagctgagagcctacctggagggcgagtgcgtggagtggctccgcggatacctggagaacgggaaggagacgctgcagcgcgcggaacgcccaaagacacacgtgacccaccatcccgtctctgaccatgaggccaccctgaggtgctgggccctgggcttctaccctgcggagatcacactgacctggcagcgggatggggaggaccaaactcaggacaccgagcttgtggagaccaggccagcaggagatggaaccttccagaagtgggcagctgtggtggtgccttctggacaagaacagagatacacgtgccatgtgcagcacgaggggctgcaggagccctgcaccctgagatggaagccgtcttcccagcccaccatccccaacttgggcatcgtttctggcccagctgtcctggctgtcctggctgtcctggctgtcctagctgtcctaggagctgtggtcgctgctgtgatac

SEQ ID NO: 1776 - DNA, 1094 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatggaagccgtcttcccagcccaccatccccatcgtgggcatcgttgctggcctggctgtcctggttgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1777 - DNA, 1094 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatggaagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaa

SEQ ID NO: 1778 - DNA, 18 bp, artificial sequence
  probe for detection
caccctccagtggatgtg

SEQ ID NO: 1779 - DNA, 18 bp, artificial sequence
  probe for detection
ccgcgggtatgaccagta

SEQ ID NO: 1780 - DNA, 16 bp, artificial sequence
  probe for detection
gaccgccgcggacacc

SEQ ID NO: 1781 - DNA, 18 bp, artificial sequence
  probe for detection
agaagtgggcagctgtga

SEQ ID NO: 1782 - DNA, 17 bp, artificial sequence
  probe for detection
cctcctccgcgggtata

SEQ ID NO: 1783 - DNA, 16 bp, artificial sequence
  probe for detection
gcgctcctggaccgct

SEQ ID NO: 1784 - DNA, 16 bp, artificial sequence
  probe for detection
gcacgaggggctgcca

SEQ ID NO: 1785 - DNA, 18 bp, artificial sequence
  probe for detection
ctgtcctaggagctgtga

SEQ ID NO: 1786 - DNA, 18 bp, artificial sequence
  probe for detection
caccctccagaggatgtc

SEQ ID NO: 1787 - DNA, 16 bp, artificial sequence
  probe for detection
gggaggcggcccgtgt

SEQ ID NO: 1788 - DNA, 16 bp, artificial sequence
  probe for detection
gggcgcctcctccgca

SEQ ID NO: 1789 - DNA, 17 bp, artificial sequence
  probe for detection
caagtgggaggcggcct

SEQ ID NO: 1790 - DNA, 17 bp, artificial sequence
  probe for detection
ccgtgaggcggagcagt

SEQ ID NO: 1791 - DNA, 19 bp, artificial sequence
  probe for detection
agtgaacctgcggaaacta

SEQ ID NO: 1792 - DNA, 18 bp, artificial sequence
  probe for detection
ccctgggcttctacccta

SEQ ID NO: 1793 - DNA, 16 bp, artificial sequence
  probe for detection
gaccgccgcggacaca

SEQ ID NO: 1794 - DNA, 16 bp, artificial sequence
  probe for detection
gctgtgtcccggccca

SEQ ID NO: 1795 - DNA, 16 bp, artificial sequence
  probe for detection
gaccgccgcggacacg

SEQ ID NO: 1796 - DNA, 17 bp, artificial sequence
  probe for detection
ccctgagatgggagcca

SEQ ID NO: 1797 - DNA, 18 bp, artificial sequence
  probe for detection
ggtctcacaccctccaga

SEQ ID NO: 1798 - DNA, 17 bp, artificial sequence
  probe for detection
cgcgggtatgaccagtc

SEQ ID NO: 1799 - DNA, 17 bp, artificial sequence
  probe for detection
gcctacctggagggcga

SEQ ID NO: 1800 - DNA, 18 bp, artificial sequence
  probe for detection
ctcccactccatgaggtg

SEQ ID NO: 1801 - DNA, 18 bp, artificial sequence
  probe for detection
cgcgggcatgaccagtta

SEQ ID NO: 1802 - DNA, 19 bp, artificial sequence
  probe for detection
ggaccaaactcaggacact

SEQ ID NO: 1803 - DNA, 17 bp, artificial sequence
  probe for detection
caaccagagcgaggcca

SEQ ID NO: 1804 - DNA, 18 bp, artificial sequence
  probe for detection
aggccaggtctcacatca

SEQ ID NO: 1805 - DNA, 17 bp, artificial sequence
  probe for detection
gaagtgggcagctgtgg

SEQ ID NO: 1806 - DNA, 15 bp, artificial sequence
  probe for detection
gcggacacggcggcc

SEQ ID NO: 1807 - DNA, 17 bp, artificial sequence
  probe for detection
atggctgcgacgtggga

SEQ ID NO: 1808 - DNA, 17 bp, artificial sequence
  probe for detection
ggccgggtctcacatca

SEQ ID NO: 1809 - DNA, 19 bp, artificial sequence
  probe for detection
catcatccagaggatgtac

SEQ ID NO: 1810 - DNA, 19 bp, artificial sequence
  probe for detection
ccgcagatacctgaagaat

SEQ ID NO: 1811 - DNA, 17 bp, artificial sequence
  probe for detection
ctcacaccctccagagc

SEQ ID NO: 1812 - DNA, 17 bp, artificial sequence
  probe for detection
ctcctccgcgggtatgt

SEQ ID NO: 1813 - DNA, 19 bp, artificial sequence
  probe for detection
cacagactgaccgagtgaa

SEQ ID NO: 1814 - DNA, 18 bp, artificial sequence
  probe for detection
cgagtgaacctgcggaaa

SEQ ID NO: 1815 - DNA, 18 bp, artificial sequence
  probe for detection
ggatgtatggctgcgacg

SEQ ID NO: 1816 - DNA, 17 bp, artificial sequence
  probe for detection
gcctacctggagggcct

SEQ ID NO: 1817 - DNA, 18 bp, artificial sequence
  probe for detection
gaccgggagacacagaac

SEQ ID NO: 1818 - DNA, 17 bp, artificial sequence
  probe for detection
ggagccccacttcatcg

SEQ ID NO: 1819 - DNA, 18 bp, artificial sequence
  probe for detection
cgagtgagcctgcggaaa

SEQ ID NO: 1820 - DNA, 18 bp, artificial sequence
  probe for detection
cgcgggtatgaccagtta

SEQ ID NO: 1821 - DNA, 15 bp, artificial sequence
  probe for detection
ggaggcggcccgtgc

SEQ ID NO: 1822 - DNA, 18 bp, artificial sequence
  probe for detection
ctacaaccagagcgagga

SEQ ID NO: 1823 - DNA, 17 bp, artificial sequence
  probe for detection
cgtgaggcggagcagct

SEQ ID NO: 1824 - DNA, 19 bp, artificial sequence
  probe for detection
ctagctgtcctaggagcta

SEQ ID NO: 1825 - DNA, 18 bp, artificial sequence
  probe for detection
ggctacgtggacgacaca

SEQ ID NO: 1826 - DNA, 16 bp, artificial sequence
  probe for detection
gccgcggagagcccca

SEQ ID NO: 1827 - DNA, 19 bp, artificial sequence
  probe for detection
gagatacacgtgccatgtt

SEQ ID NO: 1828 - DNA, 16 bp, artificial sequence
  probe for detection
gaggggagccgcggga

SEQ ID NO: 1829 - DNA, 17 bp, artificial sequence
  probe for detection
catcgcagtgggctacc

SEQ ID NO: 1830 - DNA, 16 bp, artificial sequence
  probe for detection
ctgcgacctggggccg

SEQ ID NO: 1831 - DNA, 18 bp, artificial sequence
  probe for detection
tctccacatccgtgtcct

SEQ ID NO: 1832 - DNA, 17 bp, artificial sequence
  probe for detection
caagcgccaggcacagg

SEQ ID NO: 1833 - DNA, 16 bp, artificial sequence
  probe for detection
ggaccgccgcggacaa

SEQ ID NO: 1834 - DNA, 17 bp, artificial sequence
  probe for detection
ctcaccctgagatgggg

SEQ ID NO: 1835 - DNA, 17 bp, artificial sequence
  probe for detection
tgtgcgtggagtggctg

SEQ ID NO: 1836 - DNA, 19 bp, artificial sequence
  probe for detection
ccatctctgaccatgaggt

SEQ ID NO: 1837 - DNA, 18 bp, artificial sequence
  probe for detection
acctggagaacgggaaga

SEQ ID NO: 1838 - DNA, 18 bp, artificial sequence
  probe for detection
ccgcgggtataaccagtt

SEQ ID NO: 1839 - DNA, 15 bp, artificial sequence
  probe for detection
ggagccgcgggcgcg

SEQ ID NO: 1840 - DNA, 16 bp, artificial sequence
  probe for detection
tccgagaggggagccc

SEQ ID NO: 1841 - DNA, 19 bp, artificial sequence
  probe for detection
gaggtatttctacaccgct

SEQ ID NO: 1842 - DNA, 16 bp, artificial sequence
  probe for detection
cgacgccgcgagtcca

SEQ ID NO: 1843 - DNA, 17 bp, artificial sequence
  probe for detection
gtccaagaggggagccc

SEQ ID NO: 1844 - DNA, 16 bp, artificial sequence
  probe for detection
gcgccgtgggtggaga

SEQ ID NO: 1845 - DNA, 18 bp, artificial sequence
  probe for detection
caccctccagaggatgta

SEQ ID NO: 1846 - DNA, 18 bp, artificial sequence
  probe for detection
gatcacccagcgcaagtt

SEQ ID NO: 1847 - DNA, 16 bp, artificial sequence
  probe for detection
gacgctgcagcgcgca

SEQ ID NO: 1848 - DNA, 20 bp, artificial sequence
  probe for detection
ctctgatgagtctctcatca

SEQ ID NO: 1849 - DNA, 18 bp, artificial sequence
  probe for detection
gagccatcttcccagcct

SEQ ID NO: 1850 - DNA, 17 bp, artificial sequence
  probe for detection
gagcctacctggaggga

SEQ ID NO: 1851 - DNA, 16 bp, artificial sequence
  probe for detection
tgcggcggagcaggac

SEQ ID NO: 1852 - DNA, 18 bp, artificial sequence
  probe for detection
aacctgcgcggctactat

SEQ ID NO: 1853 - DNA, 19 bp, artificial sequence
  probe for detection
gtctcacaccctccagaat

SEQ ID NO: 1854 - DNA, 18 bp, artificial sequence
  probe for detection
agctgtggtcaccgctaa

SEQ ID NO: 1855 - DNA, 18 bp, artificial sequence
  probe for detection
caccctccagaggatgtt

SEQ ID NO: 1856 - DNA, 18 bp, artificial sequence
  probe for detection
aggacgggtctcacatca

SEQ ID NO: 1857 - DNA, 19 bp, artificial sequence
  probe for detection
acatcatccagaggatgtc

SEQ ID NO: 1858 - DNA, 17 bp, artificial sequence
  probe for detection
tgctctcaggctgcgtg

SEQ ID NO: 1859 - DNA, 18 bp, artificial sequence
  probe for detection
ccgcgggtatgaccagtt

SEQ ID NO: 1860 - DNA, 17 bp, artificial sequence
  probe for detection
ggagacgctgcagcgca

SEQ ID NO: 1861 - DNA, 16 bp, artificial sequence
  probe for detection
gcccctcaccctgagc

SEQ ID NO: 1862 - DNA, 17 bp, artificial sequence
  probe for detection
gggagctgctctcaggt

SEQ ID NO: 1863 - DNA, 17 bp, artificial sequence
  probe for detection
cgtacggcggagcagct

SEQ ID NO: 1864 - DNA, 18 bp, artificial sequence
  probe for detection
accctccagaggatgtac

SEQ ID NO: 1865 - DNA, 16 bp, artificial sequence
  probe for detection
tgggaggcggcccgta

SEQ ID NO: 1866 - DNA, 19 bp, artificial sequence
  probe for detection
cgcagatacctggagaaca

SEQ ID NO: 1867 - DNA, 16 bp, artificial sequence
  probe for detection
gcctacctggagggcg

SEQ ID NO: 1868 - DNA, 18 bp, artificial sequence
  probe for detection
gatacctggagaacgggg

SEQ ID NO: 1869 - DNA, 17 bp, artificial sequence
  probe for detection
acctgcgctcctggact

SEQ ID NO: 1870 - DNA, 16 bp, artificial sequence
  probe for detection
gcgctcctggaccgcg

SEQ ID NO: 1871 - DNA, 17 bp, artificial sequence
  probe for detection
agagccccgcttcatcg

SEQ ID NO: 1872 - DNA, 18 bp, artificial sequence
  probe for detection
caccctccagtggatgta

SEQ ID NO: 1873 - DNA, 17 bp, artificial sequence
  probe for detection
cagtccgcctacgacgt

SEQ ID NO: 1874 - DNA, 17 bp, artificial sequence
  probe for detection
acaggctgaccgagtgg

SEQ ID NO: 1875 - DNA, 20 bp, artificial sequence
  probe for detection
cactccatgaggtatttctc

SEQ ID NO: 1876 - DNA, 18 bp, artificial sequence
  probe for detection
caccctccagtggatgtt

SEQ ID NO: 1877 - DNA, 18 bp, artificial sequence
  probe for detection
acaggctgaccgagtgaa

SEQ ID NO: 1878 - DNA, 18 bp, artificial sequence
  probe for detection
atcgccctgaacgaggat

SEQ ID NO: 1879 - DNA, 15 bp, artificial sequence
  probe for detection
gcctcctccgcgggc

SEQ ID NO: 1880 - DNA, 17 bp, artificial sequence
  probe for detection
tcatggcgccccgaact

SEQ ID NO: 1881 - DNA, 17 bp, artificial sequence
  probe for detection
cgcgggcatgaccagtt

SEQ ID NO: 1882 - DNA, 17 bp, artificial sequence
  probe for detection
cgcgggcatgaccagtc

SEQ ID NO: 1883 - DNA, 16 bp, artificial sequence
  probe for detection
gtgcggcggagcagca

SEQ ID NO: 1884 - DNA, 18 bp, artificial sequence
  probe for detection
gctgtggtggctgttgtt

SEQ ID NO: 1885 - DNA, 16 bp, artificial sequence
  probe for detection
cgtgcggcggagcagt

SEQ ID NO: 1886 - DNA, 18 bp, artificial sequence
  probe for detection
tggtcgctgctgtgatac

SEQ ID NO: 1887 - DNA, 16 bp, artificial sequence
  probe for detection
ggctgcaggagccctg

SEQ ID NO: 1888 - DNA, 18 bp, artificial sequence
  probe for detection
ccctgatcgagacctgga

SEQ ID NO: 1889 - DNA, 18 bp, artificial sequence
  probe for detection
ccctcaccctgagatgga

SEQ ID NO: 1890 - DNA, 17 bp, artificial sequence
  probe for detection
ggcctggctgtcctggt

SEQ ID NO: 1891 - DNA, 17 bp, artificial sequence
  probe for detection
gtggatgtgtggctgcg

SEQ ID NO: 1892 - DNA, 18 bp, artificial sequence
  probe for detection
atgaccagtacgcctacg

SEQ ID NO: 1893 - DNA, 16 bp, artificial sequence
  probe for detection
gcggacaccgcggctc

SEQ ID NO: 1894 - DNA, 18 bp, artificial sequence
  probe for detection
gcagctgtgatggtgcct

SEQ ID NO: 1895 - DNA, 18 bp, artificial sequence
  probe for detection
cgcgggtataaccagttc

SEQ ID NO: 1896 - DNA, 17 bp, artificial sequence
  probe for detection
tggaccgctgcggacac

SEQ ID NO: 1897 - DNA, 16 bp, artificial sequence
  probe for detection
gggctgccagagcccc

SEQ ID NO: 1898 - DNA, 18 bp, artificial sequence
  probe for detection
ggagctgtgatggctgtt

SEQ ID NO: 1899 - DNA, 17 bp, artificial sequence
  probe for detection
gaggatgtctggctgcg

SEQ ID NO: 1900 - DNA, 16 bp, artificial sequence
  probe for detection
ggcccgtgtggcggag

SEQ ID NO: 1901 - DNA, 18 bp, artificial sequence
  probe for detection
ctcctccgcaggtatgac

SEQ ID NO: 1902 - DNA, 16 bp, artificial sequence
  probe for detection
ggcggcctgtgaggcg

SEQ ID NO: 1903 - DNA, 17 bp, artificial sequence
  probe for detection
cggagcagtggagagcc

SEQ ID NO: 1904 - DNA, 18 bp, artificial sequence
  probe for detection
gcggaaactacgcggcta

SEQ ID NO: 1905 - DNA, 19 bp, artificial sequence
  probe for detection
ttctaccctacggagatca

SEQ ID NO: 1906 - DNA, 16 bp, artificial sequence
  probe for detection
gcggacacagcggctc

SEQ ID NO: 1907 - DNA, 15 bp, artificial sequence
  probe for detection
ccggcccagccgcgg

SEQ ID NO: 1908 - DNA, 16 bp, artificial sequence
  probe for detection
gcggacacggcggctc

SEQ ID NO: 1909 - DNA, 18 bp, artificial sequence
  probe for detection
atgggagccatcttccca

SEQ ID NO: 1910 - DNA, 19 bp, artificial sequence
  probe for detection
accctccagaggatgtatg

SEQ ID NO: 1911 - DNA, 17 bp, artificial sequence
  probe for detection
tgaccagtccgcctacg

SEQ ID NO: 1912 - DNA, 16 bp, artificial sequence
  probe for detection
ggagggcgagtgcgtg

SEQ ID NO: 1913 - DNA, 19 bp, artificial sequence
  probe for detection
ccatgaggtgtttctacac

SEQ ID NO: 1914 - DNA, 19 bp, artificial sequence
  probe for detection
tgaccagttagcctacgac

SEQ ID NO: 1915 - DNA, 19 bp, artificial sequence
  probe for detection
tcaggacactgagcttgtg

SEQ ID NO: 1916 - DNA, 17 bp, artificial sequence
  probe for detection
gcgaggccaggtctcac

SEQ ID NO: 1917 - DNA, 19 bp, artificial sequence
  probe for detection
tctcacatcatccagagga

SEQ ID NO: 1918 - DNA, 17 bp, artificial sequence
  probe for detection
cagctgtggtggtgcct

SEQ ID NO: 1919 - DNA, 17 bp, artificial sequence
  probe for detection
acggcggcccagatcac

SEQ ID NO: 1920 - DNA, 16 bp, artificial sequence
  probe for detection
gacgtgggacccgacg

SEQ ID NO: 1921 - DNA, 18 bp, artificial sequence
  probe for detection
gaggatgtacggctgcga

SEQ ID NO: 1922 - DNA, 19 bp, artificial sequence
  probe for detection
cctgaagaatgggaaggag

SEQ ID NO: 1923 - DNA, 18 bp, artificial sequence
  probe for detection
cctccagagcatgtacgg

SEQ ID NO: 1924 - DNA, 18 bp, artificial sequence
  probe for detection
gcgggtatgtccagtacg

SEQ ID NO: 1925 - DNA, 17 bp, artificial sequence
  probe for detection
ccgagtgaacctgcgga

SEQ ID NO: 1926 - DNA, 17 bp, artificial sequence
  probe for detection
ctgcggaaactgcgcgg

SEQ ID NO: 1927 - DNA, 16 bp, artificial sequence
  probe for detection
ctgcgacgtggggccc

SEQ ID NO: 1928 - DNA, 16 bp, artificial sequence
  probe for detection
ggagggcctgtgcgtg

SEQ ID NO: 1929 - DNA, 19 bp, artificial sequence
  probe for detection
gacacagaactacaagcgc

SEQ ID NO: 1930 - DNA, 18 bp, artificial sequence
  probe for detection
cacttcatcgcagtgggc

SEQ ID NO: 1931 - DNA, 15 bp, artificial sequence
  probe for detection
gcccgtgcggcggag

SEQ ID NO: 1932 - DNA, 17 bp, artificial sequence
  probe for detection
gagcgaggacgggtctc

SEQ ID NO: 1933 - DNA, 17 bp, artificial sequence
  probe for detection
ggagcagctgagagcct

SEQ ID NO: 1934 - DNA, 18 bp, artificial sequence
  probe for detection
ctaggagctatggtggct

SEQ ID NO: 1935 - DNA, 18 bp, artificial sequence
  probe for detection
ggacgacacacagttcgt

SEQ ID NO: 1936 - DNA, 18 bp, artificial sequence
  probe for detection
gagagccccacttcatcg

SEQ ID NO: 1937 - DNA, 18 bp, artificial sequence
  probe for detection
gtgccatgttcagcacga

SEQ ID NO: 1938 - DNA, 15 bp, artificial sequence
  probe for detection
ccgcgggagccgtgg

SEQ ID NO: 1939 - DNA, 17 bp, artificial sequence
  probe for detection
tgggctacctggacgac

SEQ ID NO: 1940 - DNA, 15 bp, artificial sequence
  probe for detection
ctggggccggacggg

SEQ ID NO: 1941 - DNA, 16 bp, artificial sequence
  probe for detection
cgtgtcctggcccggc

SEQ ID NO: 1942 - DNA, 17 bp, artificial sequence
  probe for detection
aggcacaggctgaccga

SEQ ID NO: 1943 - DNA, 16 bp, artificial sequence
  probe for detection
cgcggacaaggcggct

SEQ ID NO: 1944 - DNA, 18 bp, artificial sequence
  probe for detection
tgagatgggggccatctt

SEQ ID NO: 1945 - DNA, 18 bp, artificial sequence
  probe for detection
ggagtggctgcgcagata

SEQ ID NO: 1946 - DNA, 18 bp, artificial sequence
  probe for detection
accatgaggtcaccctga

SEQ ID NO: 1947 - DNA, 18 bp, artificial sequence
  probe for detection
aacgggaagaagacgctg

SEQ ID NO: 1948 - DNA, 19 bp, artificial sequence
  probe for detection
ataaccagttcgcctacga

SEQ ID NO: 1949 - DNA, 15 bp, artificial sequence
  probe for detection
cgggcgcggtgggtg

SEQ ID NO: 1950 - DNA, 15 bp, artificial sequence
  probe for detection
ggggagccccgggcg

SEQ ID NO: 1951 - DNA, 17 bp, artificial sequence
  probe for detection
tacaccgctgtgtcccg

SEQ ID NO: 1952 - DNA, 17 bp, artificial sequence
  probe for detection
gcgagtccaagagggga

SEQ ID NO: 1953 - DNA, 17 bp, artificial sequence
  probe for detection
gggtggagaaggagggg

SEQ ID NO: 1954 - DNA, 18 bp, artificial sequence
  probe for detection
agaggatgtatggctgcg

SEQ ID NO: 1955 - DNA, 17 bp, artificial sequence
  probe for detection
gcgcaagttggaggcgg

SEQ ID NO: 1956 - DNA, 16 bp, artificial sequence
  probe for detection
cagcgcgcagaacccc

SEQ ID NO: 1957 - DNA, 17 bp, artificial sequence
  probe for detection
ggctgcgtgcagcaaca

SEQ ID NO: 1958 - DNA, 17 bp, artificial sequence
  probe for detection
tcccagcctaccatccc

SEQ ID NO: 1959 - DNA, 17 bp, artificial sequence
  probe for detection
ctggagggactgtgcgt

SEQ ID NO: 1960 - DNA, 18 bp, artificial sequence
  probe for detection
ggagcaggacagagccta

SEQ ID NO: 1961 - DNA, 19 bp, artificial sequence
  probe for detection
cggctactataaccagagc

SEQ ID NO: 1962 - DNA, 19 bp, artificial sequence
  probe for detection
cctccagaatatgtatggc

SEQ ID NO: 1963 - DNA, 19 bp, artificial sequence
  probe for detection
tcaccgctaagatgtgtag

SEQ ID NO: 1964 - DNA, 18 bp, artificial sequence
  probe for detection
agaggatgtttggctgcg

SEQ ID NO: 1965 - DNA, 18 bp, artificial sequence
  probe for detection
atgaccagttcgcctacg

SEQ ID NO: 1966 - DNA, 16 bp, artificial sequence
  probe for detection
gggctgcaagagcccc

SEQ ID NO: 1967 - DNA, 18 bp, artificial sequence
  probe for detection
gctctcaggttgcgtgca

SEQ ID NO: 1968 - DNA, 16 bp, artificial sequence
  probe for detection
ggcccgtacggcggag

SEQ ID NO: 1969 - DNA, 19 bp, artificial sequence
  probe for detection
ctggagaacaggaagaaga

SEQ ID NO: 1970 - DNA, 16 bp, artificial sequence
  probe for detection
ggagggcgcgtgcgtg

SEQ ID NO: 1971 - DNA, 18 bp, artificial sequence
  probe for detection
cctccagagcatgtatgg

SEQ ID NO: 1972 - DNA, 18 bp, artificial sequence
  probe for detection
gagaacggggagaagacg

SEQ ID NO: 1973 - DNA, 16 bp, artificial sequence
  probe for detection
tcctggactgccgcgg

SEQ ID NO: 1974 - DNA, 16 bp, artificial sequence
  probe for detection
tggaccgcggcggaca

SEQ ID NO: 1975 - DNA, 17 bp, artificial sequence
  probe for detection
gcttcatcgcagtgggc

SEQ ID NO: 1976 - DNA, 18 bp, artificial sequence
  probe for detection
agtggatgtatggctgcg

SEQ ID NO: 1977 - DNA, 19 bp, artificial sequence
  probe for detection
cctacgacgtcaaggatta

SEQ ID NO: 1978 - DNA, 16 bp, artificial sequence
  probe for detection
ccgagtgggcctgcgg

SEQ ID NO: 1979 - DNA, 19 bp, artificial sequence
  probe for detection
ggtatttctccacatccgt

SEQ ID NO: 1980 - DNA, 18 bp, artificial sequence
  probe for detection
agtggatgtttggctgcg

SEQ ID NO: 1981 - DNA, 18 bp, artificial sequence
  probe for detection
gaacgaggatctgcgctc

SEQ ID NO: 1982 - DNA, 16 bp, artificial sequence
  probe for detection
ccgcgggcatgaccag

SEQ ID NO: 1983 - DNA, 17 bp, artificial sequence
  probe for detection
ccccgaactctcctcct

SEQ ID NO: 1984 - DNA, 16 bp, artificial sequence
  probe for detection
ccgcgggcatgaccag

SEQ ID NO: 1985 - DNA, 17 bp, artificial sequence
  probe for detection
ggagcagcagagagcct

SEQ ID NO: 1986 - DNA, 19 bp, artificial sequence
  probe for detection
ggctgttgttatgtgtagg

SEQ ID NO: 1987 - DNA, 18 bp, artificial sequence
  probe for detection
tgtggtcgctgctgtgat

SEQ ID NO: 1988 - DNA, 16 bp, artificial sequence
  probe for detection
ggagccctgcaccctg

SEQ ID NO: 1989 - DNA, 16 bp, artificial sequence
  probe for detection
gacctggaccggctcc

SEQ ID NO: 1990 - DNA, 18 bp, artificial sequence
  probe for detection
ctgagatggaagccgtct

SEQ ID NO: 1991 - DNA, 18 bp, artificial sequence
  probe for detection
ctgtcctggttgtcctag

SEQ ID NO: 1992 - DNA, 23 bp, artificial sequence
  probe for detection
aaacacggtcacctcagggggat

SEQ ID NO: 1993 - DNA, 21 bp, artificial sequence
  probe for detection
ggcctgagtgtggttggaacg

SEQ ID NO: 1994 - DNA, 22 bp, artificial sequence
  probe for detection
ccagctcgtagttgtgtctgca

SEQ ID NO: 1995 - DNA, 39 bp, artificial sequence
  probe for detection
aacgttcaccttaggctggaccatgtgtcaacttatgcc

SEQ ID NO: 1996 - DNA, 17 bp, artificial sequence
  probe for detection
agaattaccttttccag

SEQ ID NO: 1997 - DNA, 17 bp, Homo sapiens
agaattacgttttccag

SEQ ID NO: 1998 - DNA, 241 bp, Homo sapiens
ccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaac

SEQ ID NO: 1999 - DNA, 222 bp, Homo sapiens
gcgtttgtacagacgcatagaccaacaggagagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaac

SEQ ID NO: 2000 - DNA, 225 bp, Homo sapiens
gccgcgtttgtacagacgcatagaccaacaggggagtttatgtttgaatttgatgacgatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaac

SEQ ID NO: 2001 - DNA, 225 bp, Homo sapiens
gccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccgccaat

SEQ ID NO: 2002 - DNA, 241 bp, Homo sapiens
ccatgtgtcaacttatgccgcgtttgtacagacgcatagaccaacaggggagtttatgtttgaatttgatgaagatgagcagttctatgtggatctggataaaaaggagaccgtctggcatctggaggagtttggccaagccttttcctttgaggctcagggcgggctggctaacattgctatattgaacaacaacttgaataccttgatccagcgttccaaccacactcaggccaccaac

SEQ ID NO: 2003 - DNA, 240 bp, Homo sapiens
catgtgtcaacttatgccgcgtttgtacagacgcatagaccaacaggggagtttatgtttgaatttgatgaagatgagatgttctatgtggatctggacaagaaggagaccgtctggcatctggaggagtttggccaaaccttttcctttgaggctcagggcgggctggctaacattgctatattgaacaacaacttgaataccttgatccagcgttccaaccacactcaggccaccaac

SEQ ID NO: 2004 - DNA, 241 bp, Homo sapiens
ccatgtgtcaacttatgccgcgtttgtacagacgcatagaccaacaggggagtttatgtttgaatttgatgacgatgagatgttctatgtggatctggacaagaaggagaccgtctggcatctggaggagtttggccgagccttttcctttgaggctcagggcgggctggctaacattgctatattgaacaacaacttgaataccttgatccagcgttccaaccacactcaggccaccaac

SEQ ID NO: 2005 - DNA, 241 bp, Homo sapiens
ccatgtgtcaacttatgccgcgtttgtacagacccatagaccaacaggggagtttatgtttgaatttgatgaagatgagcagttctatgtggatctggataaaaaggagaccgtctggcatctggaggagtttggccgagccttttcctttgaggctcagggcgggctggctaacattgctatattgaacaacaacttgaataccttgatccagcgttccaaccacactcaggccgccaat

SEQ ID NO: 2006 - DNA, 241 bp, Homo sapiens
ccatgtgtcaacttatgccgcgtttgtacagacgcatagaccaacaggggagtttatgtttgaatttgatgaagatgagcagttctatgtggatctggataaaaaggagaccgtctggcatctggaggagtttggccgagccttttcctttgaggctcagggcgggctggctaacattgctatattgaacaacaacttgaataccttgatccagcgttccaaccacactcaggccgccaat

SEQ ID NO: 2007 - DNA, 241 bp, Homo sapiens
ccatgtgtcaacttatgccgcgtttgtacagacgcatagaccaacaggggagtttatgtttgaatttgatgaagatgagcagttctatgtggatctggacaagaaggagaccgtctggcatctggaggagtttggccgagccttttcctttgaggctcagggcgggctggctaacattgctatattgaacaacaacttgaataccttgatccagcgttccaaccacactcaggccgccaat

SEQ ID NO: 2008 - DNA, 222 bp, Homo sapiens
gcgtttgtacaaacccatagaccaacaggggagtttatgtttgaatttgatgaagatgagcagttctatgtggatctggataaaaaggagaccgtctggcatctggaggagtttggccgagccttttcctttgaggctcagggcgggctggctaacattgctatattgaacaacaacttgaataccttgatccagcgttccaaccacactcaggccgccaat

SEQ ID NO: 2009 - DNA, 241 bp, Homo sapiens
ccatgtgtcaacttatgccgcgtttgtacagacgcatagaccaacaggagagtttatgtttgaatttgatgaagatgagcagttctatgtggatctggacaagaaggagaccgtctggcatctggaggagtttggccgagccttttcctttgaggctcagggcgggctggctaacattgctatattgaacaacaacttgaataccttgatccagcgttccaaccacactcaggccgccaat

SEQ ID NO: 2010 - DNA, 241 bp, Homo sapiens
ccatgtgtcaacttatgccgcgtttgtacagacccatagaccaacaggggagtttatgtttgaatttgatgaagatgagcagttctatgtggatctggataagaaggagaccgtctggcatctggaggagtttggccgagccttttcctttgaggctcagggcgggctggctaacattgctatattgaacaacaacttgaataccttgatccagcgttccaaccacactcaggccgccaat

SEQ ID NO: 2011 - DNA, 232 bp, Homo sapiens
aacttatgccatgtttgtacagacccatagaccaacaggagagtttatgtttgaatttgatgaagatgagcagttctatgtggatctggataagaaggagaccgtctggcatctggaggagtttggccgagccttttcctttgaggctcagggcgggctggctaacattgctatattgaacaacaacttgaataccttgatccagcgttccaaccacactcaggccgccaat

SEQ ID NO: 2012 - DNA, 241 bp, Homo sapiens
ccatgtgtcaacttatgccatgtttgtacagacccatagaccaacaggagagtttatgtttgaatttgatgaagatgagcagttctatgtggatctggacaagaaggagaccgtctggcatctggaggagtttggccgagccttttcctttgaggctcagggcgggctggctaacattgctatattgaacaacaacttgaataccttgatccagcgttccaaccacactcaggccgccaat

SEQ ID NO: 2013 - DNA, 239 bp, Homo sapiens
atgtgtcaacttatgccatgtttgtacagacccatagaccaacaggggagtttatgtttgaatttgatgaagatgagcagttctatgtggatctggacaagaaggagaccgtctggcatctggaggagtttggccgagccttttcctttgaggctcagggcgggctggctaacattgctatattgaacaacaacttgaataccttgatccagcgttccaaccacactcaggccgccaat

SEQ ID NO: 2014 - DNA, 241 bp, Homo sapiens
ccatgtgtcaacttatgccgcgtttgtacagacccatagaccaacaggggagtttatgtttgaatttgatgaagatgagatgttctatgtggatctggacaagaaggagaccgtctggcatctggaggagtttggccgagccttttcctttgaggctcagggcgggctggctaacattgctatattgaacaacaacttgaataccttgatccagcgttccaaccacactcaggccgccaat

SEQ ID NO: 2015 - DNA, 225 bp, Homo sapiens
gccatgtttgtacagacccatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatatcgaacaacaacttgaataccttgatccagcgttccaaccacactcaggccaccaac

SEQ ID NO: 2016 - DNA, 241 bp, Homo sapiens
ccatgtgtcaacttatgccatgtttgtacagacccatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaac

SEQ ID NO: 2017 - DNA, 225 bp, Homo sapiens
gccgcgtttgtacagacgcatagaacaacaggagagtttatgtttgagtttgatgatgatgagatgttctatgtggatctggacaagaaggagaccgtctggcatctggaggagtttggccgagccttttcctttgaggctcagggcgggctggctaacattgctatattgaacaacaacttgaatatcgctatccagcgttccaaccacactcaggccgccaat

SEQ ID NO: 2018 - DNA, 267 bp, Homo sapiens
agaattacgtgtaccagggacggcaggaatgctacgcgtttaatgggacacagcgcttcctggagagatacatctacaaccgggaggagtacgcgcgcttcgacagcgacgtgggggagttccgggcggtgacggagctggggcggcctgctgcggagtactggaacagccagaaggacatcctggaggagaagcgggcagtgccggacagggtatgcagacacaactacgagctggacgaggccgtgaccctgcagcgccgagtcc

SEQ ID NO: 2019 - DNA, 261 bp, Homo sapiens
aattacgtgtaccagggacggcaggaatgctacgcgtttaatgggacacagcgcttcctggagagatacatctacaaccgggaggagtacgcgcgcttcgacagcgacgtgggagagttccgggcggtgacggagctggggcggcctgctgcggagtactggaacagccagaaggacatcctggaggagaagcgggcagtgccggacagggtatgcagacacaactacgagctggacgaggccgtgaccctgcagcgccga

SEQ ID NO: 2020 - DNA, 267 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgagtcc

SEQ ID NO: 2021 - DNA, 267 bp, Homo sapiens; identical to SEQ ID NO: 2020

SEQ ID NO: 2022 - DNA, 264 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgacgaggagtactggaacagccagaaggacatcctggaggaggagcgggcagtgccggacaggatgtgcagacacaactacgagctgggcgggcccatgaccctgcagcgccgag

SEQ ID NO: 2023 - DNA, 263 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagttccggacaggatgtgcagacacaactacgagctgggcgggcccatgaccctgcagcgccga

SEQ ID NO: 2024 - DNA, 264 bp, Homo sapiens
agaattaccttttccagggacggcaggaatgctacgcgtttaatgggacacagcgcttcctggagagatacatctacaaccgggaagagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgag

SEQ ID NO: 2025 - DNA, 264 bp, Homo sapiens
agaattaccttttccagggacggcaggaatgctacgcgtttaatgggacacagcgcttcctggagagatacatctacaaccgggaggagtttgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgag

SEQ ID NO: 2026 - DNA, 264 bp, Homo sapiens
agaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgag

SEQ ID NO: 2027 - DNA, 267 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgagtcc

SEQ ID NO: 2028 - DNA, 264 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctacagcgccgag

SEQ ID NO: 2029 - DNA, 267 bp, Homo sapiens
agaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgagtcc

SEQ ID NO: 2030 - DNA, 267 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtcc

SEQ ID NO: 2031 - DNA, 264 bp, Homo sapiens
agaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggagaagcgggcagtgccggacaggatgtgcagacacaactacgagctggacgaggccgtgaccctgcagcgccgag

SEQ ID NO: 2032 - DNA, 257 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggaggagcgggcagtgccggacaggatgtgcagacacaactacgagctggacgaggccgtgaccctgcag

SEQ ID NO: 2033 - DNA, 249 bp, Homo sapiens
cttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacagggtatgcagacacaactacgagctggacgaggccgtgaccctgcag

SEQ ID NO: 2034 - DNA, 264 bp, Homo sapiens
agaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacatcctggaggaggagcgggcagtgccggacagggtatgcagacacaactacgagctggacgaggccgtgaccctgcagcgccgag

SEQ ID NO: 2035 - DNA, 264 bp, Homo sapiens
agaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacagggtatgcagacacaactacgagctggacgaggccgtgaccctgcagcgccgag

SEQ ID NO: 2036 - DNA, 249 bp, Homo sapiens
gtgtaccagttacggcaggaatgctacgcgtttaatgggacacagcgcttcctggagagatacatctacaaccggcaggagtacgcgcgcttcgacagcgacgtgggagagttccgggcggtgacggagctggggcggcctgctgcggagtactggaacagccagaaggacctcctggaggagaggcgggcagtgccggacaggatgtgcagacacaactacgagctggacgaggccgtgaccctgcag

SEQ ID NO: 2037 - DNA, 257 bp, Homo sapiens
agaattacgtgtaccagttacggcaggaatgctacgcgtttaatgggacacagcgcttcctggagagatacatctacaacaggcaggagtacgcgcgcttcgacagcgacgtgggagagttccgggcggtgacggagctggggcggcctgctgcggagtactggaacagccagaaggacctcctggaggagaggcgggcagtgccggacaggatgtgcagacacaactacgagctggacgaggccgtgaccctgcag

SEQ ID NO: 2038 - DNA, 257 bp, Homo sapiens
agaattacgtgtaccagttacggcaggaatgctacgcgtttaatgggacacagcgcttcctggagagatacatctacaaccgggaggagtacgcgcgcttcgacagcgacgtgggggagttccgggcggtgacggagctggggcggcctgctgcggagtactggaacagccagaaggacatcctggaggaggagcgggcagtgccggacaggatatgcagacacaactacgagctggacgaggccgtgaccctgcag

SEQ ID NO: 2039 - DNA, 257 bp, Homo sapiens
agaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcag

SEQ ID NO: 2040 - DNA, 264 bp, Homo sapiens
agaattacgtgtaccagggacggcaggaatgctacgcgtttaatgggacacagcgcttcctggagagatacatctacaaccggcaggagtacgcgcgcttcgacagcgacgtgggagagttccgggcggtgacggagctggggcggcctgctgcggagtactggaacagccagaaggacctcctggaggagaggcgggcagtgccggacaggatgtgcagacacaactacgagctggtcgggcccatgaccctgcagcgccgag

SEQ ID NO: 2041 - DNA, 264 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctggacgaggccgtgaccctgcagcgccgag

SEQ ID NO: 2042 - DNA, 264 bp, Homo sapiens
agaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacatcctggaggaggagcgggcagtgccggacaggatgtgcagacacaactacgagctggacgaggccgtgaccctgcagcgccgag

SEQ ID NO: 2043 - DNA, 249 bp, Homo sapiens
gtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctggtcgggcccatgaccctgcag

SEQ ID NO: 2044 - DNA, 264 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgaggcggagtactggaacagccagaaggacatcctggaggaggagcgggcagtgccggacaggatatgcagacacaactacgagctggacgaggccgtgaccctgcagcgccgag

SEQ ID NO: 2045 - DNA, 264 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacaggatgtgcagacacaactacgagctggacgaggccgtgaccctgcagcgccgag

SEQ ID NO: 2046 - DNA, 263 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacaggatgtgcagacacaactacgagctggacgaggccgtgaccctgcagcgtcga

SEQ ID NO: 2047 - DNA, 264 bp, Homo sapiens
agaattacgtgtaccagttacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctggacgaggccgtgaccctgcagcgccgag

SEQ ID NO: 2048 - DNA, 264 bp, Homo sapiens
agaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctggacgaggccgtgaccctgcagcgccgag

SEQ ID NO: 2049 - DNA, 264 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgag

SEQ ID NO: 2050 - DNA, 264 bp, Homo sapiens
agaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgaggcggagtactggaacagccagaaggacatcctggaggagaagcgggcagtgccggacaggatgtgcagacacaactacgagctgggcgggcccatgaccctgcagcgccgag

SEQ ID NO: 2051 - DNA, 264 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacctcctggaggagaagcgggcagtgccggacagggtatgcagacacaactacgagctggacgaggccgtgaccctgcagcgccgag

SEQ ID NO: 2052 - DNA, 256 bp, Homo sapiens
gtgtaccagttacggcaggaatgctacgcgtttaatgggacacagcgcttcctggagagatacatctacaaccgggaggagtacgcgcgcttcgacagcgacgtgggagagttccgggcggtgacggagctggggcggcctgctgcggagtactggaacagccagaaggacatcctggaggagaagcgggcagtgccggacagagtatgcagacacaactacgagctggacgaggccgtgaccctgcagcgccgag

SEQ ID NO: 2053 - DNA, 255 bp, Homo sapiens
gtgtaccagttacggcaggaatgctacgcgtttaatgggacacagcgcttcctggagagatacatctacaaccgggaggagtacgcgcgcttcgacagcgacgtgggggagttccgggcggtgacggagctggggcggcctgctgcggagtactggaacagccagaaggacatcctggaggagaagcgggcagtgccggacagggtatgcagacacaactacgagctggacgaggccgtgaccctgcagcgccga

SEQ ID NO: 2054 - DNA, 264 bp, Homo sapiens
agaattacgtgtaccagttacggcaggaatgctacgcgtttaatgggacacagcgcttcctggagagatacatctacaaccgggaggagtacgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctggacgaggccgtgaccctgcagcgccgag

SEQ ID NO: 2055 - DNA, 264 bp, Homo sapiens
agaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgatgaggagtactggaacagccagaaggacctcctggaggagaagcgggcagtgccggacaggatgtgcagacacaactacgagctggtcgggcccatgaccctgcagcgccgag

SEQ ID NO: 2056 - DNA, 264 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggaggagcgggcagtgccggacagggtatgcagacacaactacgagctggacgaggccgtgaccctgcagcgccgag

SEQ ID NO: 2057 - DNA, 257 bp, Homo sapiens
agaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctggacgaggccgtgaccctgcag

SEQ ID NO: 2058 - DNA, 264 bp, Homo sapiens
agaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacctcctggaggagaagcgggcattgccggacaggatgtgcagacacaactacgagctggacgaggccgtgaccctgcagcgccgag

SEQ ID NO: 2059 - DNA, 264 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggtgtactggaacagccagaaggacatcctggaggaggagcgggcagtgccggacaggatgtgcagacacaactacgagctgggcgggcccatgaccctgcagcgccgag

SEQ ID NO: 2060 - DNA, 257 bp, Homo sapiens
agaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggaggagcgggcagtgccggacaggatgtgcagacacaactacgagctgggcgggcccatgaccctgcag

SEQ ID NO: 2061 - DNA, 257 bp, Homo sapiens
agaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgctgcggagtactggaacagccagaaggacctcctggaggagaagcgggcattgccggacaggatgtgcagacacaactacgagctggtcgggcccatgaccctgcag

SEQ ID NO: 2062 - DNA, 257 bp, Homo sapiens
agaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacatcctggaggagaagcgggcagtgccggacagggtatgcagacacaactacgagctggacgaggccgtgaccctgcag

SEQ ID NO: 2063 - DNA, 264 bp, Homo sapiens
agaattacgtgtaccagttacggcaggaatgctacgcgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggagaagcgggcagtgccggacaggatgtgcagacacaactacgagctggacgaggccgtgaccctgcagcgccgag

SEQ ID NO: 2064 - DNA, 256 bp, Homo sapiens
gtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacagggtatgcagacacaactacgagctggacgaggccgtgaccctgcagcgccgag

SEQ ID NO: 2065 - DNA, 249 bp, Homo sapiens
cttttccagggacggcaggaatgctacccgtttaatgggacacagcgcttcctggagagatacatctacaaccgggaggagctcgtgcgcttcgacagcgacgtgggggagttccgggcggtgacggagctggggcggcctgaggcggagtactggaacagccagaaggacatcctggaggagaagcgggcagtgccggacaggatgtgcagacacaactacgagctggacgaggccgtgaccctgcag

SEQ ID NO: 2066 - DNA, 263 bp, Homo sapiens
agaattaccttttccagggacggcaggaatgctacgcgtttaatgggacacagcgcttcctggagagatacatctacaaccgggaggagtacgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccga

SEQ ID NO: 2067 - DNA, 263 bp, Homo sapiens
agaattaccttttccagggacggcaggaatgctacgcgtttaatgggacacagcgcttcctggagagatacatctacaaccgggaggagtacgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctggtcgggcccatgaccctgcagcgccga

SEQ ID NO: 2068 - DNA, 261 bp, Homo sapiens
aattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacttcctggaggaggagcgggcagtgccggacaggatgtgcagacacaactacgagctgggcgggcccatgaccctgcagcgccga

SEQ ID NO: 2069 - DNA, 264 bp, Homo sapiens
agaattacgtgtaccagttacggcaggaatgctacgcgtttaatgggacacagcgcttcctggagagatacatctacaaccgggaggagctcgtgcgcttcgacagcgacgtgggggagttccgggcggtgacggagctggggcggcctgatgaggactactggaacagccagaaggacctcctggaggaggagcgggcagtgccggacagggtatgcagacacaactacgagctggacgaggccgtgaccctgcagcgccgag

SEQ ID NO: 2070 - DNA, 249 bp, Homo sapiens
gtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacctcctggaggagaagcgggcagtgccggacagggtatgcagacacaactacgagctggacgaggccgtgaccctgcag

SEQ ID NO: 2071 - DNA, 264 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacatcctggaggaggagcgggcagtgccggacaggatgtgcagacacaactacgagctgggcgggcccatgaccctgcagcgccgag

SEQ ID NO: 2072 - DNA, 264 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgaggcggagtactggaacagccagaaggacatcctggaggaggagcgggcagtgccggacaggatgtgcagacacaactacgagctgggcgggcccatgaccctgcagcgccgag

SEQ ID NO: 2073 - DNA, 255 bp, Homo sapiens
aattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcag

SEQ ID NO: 2074 - DNA, 255 bp, Homo sapiens
aattaccttttccagggacggcaggaatgctacgcgtttaatgggacacagcgcttcctggagagatacatctacaaccgggaggagtacgcgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcag

SEQ ID NO: 2075 - DNA, 255 bp, Homo sapiens
aattacgtgtaccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcag

SEQ ID NO: 2076 - DNA, 264 bp, Homo sapiens
agaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgag

SEQ ID NO: 2077 - DNA, 257 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgctgcggagtactggaacagccagaaggacctcctggaggagaagcgggcagtgccggacagggtatgcagacacaactacgagctggacgaggccgtgaccctgcag

SEQ ID NO: 2078 - DNA, 257 bp, Homo sapiens
agaattaccttttccagggacggcaggaatgctacgcgtttaatgggacacagcgcttcctggagagatacatctacaaccgggaggagtacgcgcgcttcgacagcgacgtgggggagttccgggcggtgacggagctggggcggcctgatgaggagtactggaacagccagaaggacatcctggaggagaagcgggcagtgccggacaggatgtgcagacacaactacgagctggtcgggcccatgaccctgcag

SEQ ID NO: 2079 - DNA, 257 bp, Homo sapiens
agaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgaggcggagtactggaacagccagaaggacatcctggaggaggagcgggcagtgccggacagggtatgcagacacaactacgagctggacgaggccgtgaccctgcag

SEQ ID NO: 2080 - DNA, 257 bp, Homo sapiens
agaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgctgcggagtactggaacagccagaaggacatcctggaggaggagcgggcagtgccggacaggatgtgcagacacaactacgagctggacgaggccgtgaccctgcag

SEQ ID NO: 2081 - DNA, 249 bp, Homo sapiens
gtgtaccagttacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacctcctggaggagaagcgggcagtgccggacagggtatgcagacacaactacgagctggacgaggccgtgaccctgcag

SEQ ID NO: 2082 - DNA, 238 bp, Homo sapiens
cttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccg

SEQ ID NO: 2083 - DNA, 255 bp, Homo sapiens
aattacgtgcaccagttacggcaggaatgctacgcgtttaatgggacacagcgcttcctggagagatacatctacaaccgggaggagctcgtgcgcttcgacagcgacgtgggggagttccgggcggtgacggagctggggcggcctgctgcggagtactggaacagccagaaggacatcctggaggaggagcgggcagtgccggacaggatgtgcagacacaactacgagctggacgaggccgtgaccctgcag

SEQ ID NO: 2084 - DNA, 257 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacctcctggaggagaagcgggcagtgccggacaggatgtgcagacacaactacgagctgggcgggcccatgaccctgcag

SEQ ID NO: 2085 - DNA, 257 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacaacctggaggagaagcgggcagtgccggacaggatgtgcagacacaactacgagctgggcgggcccatgaccctgcag

SEQ ID NO: 2086 - DNA, 260 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctgtaggagaagcgggcagtgccggacagggtatgcagacacaactacgagctggacgaggccgtgaccctgcagcgc

SEQ ID NO: 2087 - DNA, 257 bp, Homo sapiens
agaattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgctgcggagtactggaacagccagaaggacatcctggaggagaagcgggcagtgccggacaggatgtgcagacacaactacgagctggtcgggcccatgaccctgcag

SEQ ID NO: 2088 - DNA, 255 bp, Homo sapiens
aattaccttttccagggacggcaggaatgctacgcgtttaatgggacacagcgcttcctggagagatacatctacaaccgggaggagctcgtgcgcttcgacagcgacgtgggggagttccgggcggtgacggagctggggcggcctgctgcggagtactggaacagccagaaggacatcctggaggagaagcgggcagtgccggacaggatgtgcagacacaactacgagctggacgaggccgtgaccctgcag

SEQ ID NO: 2089 - DNA, 255 bp, Homo sapiens
aattaagtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggaggagcgggcagtgccggacaggatgtgcagacacaactacgagctggacgaggccgtgaccctgcag

SEQ ID NO: 2090 - DNA, 264 bp, Homo sapiens
agaattaccttttccagggacggcaggaatgctacgcgtttaatgggacacagcgcttcctggagagatacatctacaaccgggaggagtacgcgcgcttcgacagcgacgtgggggagttccgggcggtgacggagctggggcggcctgctgcggagtactggaacagccagaaggacatcctggaggagaagcgggcagtgccggacagggtatgcagacacaactacgagctggacgaggccgtgaccctgcagcgccgag

SEQ ID NO: 2091 - DNA, 264 bp, Homo sapiens
agaattacgtgcaccagttacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctgggcgggcccatgaccctgcagcgccgag

SEQ ID NO: 2092 - DNA, 264 bp, Homo sapiens
agaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgctgcggagtactggaacagccagaaggacctcctggaggagaagcgggcagtgccggacagggtatgcagacacaactacgagctggacgaggccgtgaccctgcagcgccgag

SEQ ID NO: 2093 - DNA, 263 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacagggtatgcagacacaactacgagctggacgaggccgtgaccctgcagcgccga

SEQ ID NO: 2094 - DNA, 251 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaggcgggcagtgccggacaggatgtgcagacacaactacgagctggacgaggccgtgacc

SEQ ID NO: 2095 - DNA, 255 bp, Homo sapiens
aattacgtggaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcag

SEQ ID NO: 2096 - DNA, 255 bp, Homo sapiens
aattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgctgcggagtactggaacagccagaaggacatcctggaggaggagcgggcagtgccggacaggatgtgcagacacaactacgagctgggcgggcccatgaccctgcag

SEQ ID NO: 2097 - DNA, 255 bp, Homo sapiens
aattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacctcctggaggagaagcgggcagtgccggacaggatgtgcagacacaactacgagctgggcgggcccatgaccctgcag

SEQ ID NO: 2098 - DNA, 255 bp, Homo sapiens
aattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacctcctggaggagaagcgggcagtgccggacagggtatgcagacacaactacgagctgggcgggcccatgaccctgcag

SEQ ID NO: 2099 - DNA, 249 bp, Homo sapiens
gtgtaccagttacggcaggaatgctacgcgtttaatgggacacagcgcttcctggagagatacatctacaaccggcaggagtacgcgcgcttcgacagcgacgtgggagagttccgggcggtgacggagctggggcggcctgctgcggagtactggaacagccagaaggacctcctggaggagaggcgggcagtgccggacaggatgtgcagacacaactacgagctggtcgggcccatgaccctgcag

SEQ ID NO: 2100 - DNA, 249 bp, Homo sapiens
cttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacagggtatgcagacacaactacgagctgggcgggcccatgaccctgcag

SEQ ID NO: 2101 - DNA, 257 bp, Homo sapiens
agaattacgtgcaccagttacggcaggaatgctacgcgtttaatgggacacagcgcttcctggagagatacatctacaaccgggaggagttcgcgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcag

SEQ ID NO: 2102 - DNA, 264 bp, Homo sapiens
agaattaccttttccagggactgcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgag

SEQ ID NO: 2103 - DNA, 264 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgctggacagggtatgcagacacaactacgagctggacgaggccgtgaccctgcagcgccgag

SEQ ID NO: 2104 - DNA, 264 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacagggtatgcagacacaactacgagctggacgaggccgtgaccctgcagcgccgag

SEQ ID NO: 2105 - DNA, 251 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacatcctggaggagaagcgggcagtgccggacaggatgtgcagacacaactacgagctgggcgggcccatgacc

SEQ ID NO: 2106 - DNA, 264 bp, Homo sapiens
agaattaccttttccagggacggcaggaatgctacgcgtttaatgggacacagcgcttcctggagagatacatctacaaccgggaggagttcgcgcgcttcgacagcgacgtgggggagttccgggcggtgacggagctggggcggcctgatgaggagtactggaacagccagaaggacatcctggaggaggagcgggcagtgccggacaggatgtgcagacacaactacgagctgggcgggcccatgaccctgcagcgccgag

SEQ ID NO: 2107 - DNA, 264 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcaccgag

SEQ ID NO: 2108 - DNA, 264 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacttcctggaggagaagcgggcagtgccggacaggatgtgcagacacaactacgagctgggcgggcccatgaccctgcagcgccgag

SEQ ID NO: 2109 - DNA, 263 bp, Homo sapiens
agaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgaggaggagtactggaacagccagaaggacatcctggaggagaagcgggcagtgccggacagggtatgcagacacaactacgagctggacgaggccgtgaccctgcagcgccga

SEQ ID NO: 2110 - DNA, 264 bp, Homo sapiens
agaattacgtgtaccagttacggcaggaatgctacgcgtttaatgggacacagcgcttcctggagagatacatctacaaccgggaggagtacgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctggacgaggccgtgaccctgcagcaccgag

SEQ ID NO: 2111 - DNA, 262 bp, Homo sapiens
gaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacatcctggaggaggagcgggcagtgccggacaggatgtgcagacacaactacgagctgggcgggcccatgaccctgcagcgccga

SEQ ID NO: 2112 - DNA, 264 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgctgcggagtactggaacagccagaaggacctcctggaggagaagcgggcagtgccggacaggatgtgcagacacaactacgagctggacgaggccgtgaccctgcagcgccgag

SEQ ID NO: 2113 - DNA, 264 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacatcctggaggaggagcgggcagtgccggacagggtatgcagacacaactacgagctggacgaggccgtgaccctgcagcgccgag

SEQ ID NO: 2114 - DNA, 264 bp, Homo sapiens
agaattacgtgtaccagggacggcaggaatgctacgcgtttaatgggacacagcgcttcctggagagatacatctacaaccgggaggagtacgcgcgcttcgacagcgacgtgggggagttccgggcggtgacggagctggggcggcctgctgcggagtactggaacagccagaaggacatcctggaggagaagcgggcagtgccggacaggatgtgcagacacaactacgagctggacgaggccgtgaccctgcagcgccgag

SEQ ID NO: 2115 - DNA, 264 bp, Homo sapiens
agaattacgtgtaccagggacggcaggaatgctacgcgtttaatgggacacagcgcttcctggagagatacatctacaaccgggaggagttcgcgcgcttcgacagcgacgtgggggagttccgggcggtgacggagctggggcggcctgctgcggagtactggaacagccagaaggacatcctggaggagaagcgggcagtgccggacagggtatgcagacacaactacgagctggacgaggccgtgaccctgcagcgccgag

SEQ ID NO: 2116 - DNA, 264 bp, Homo sapiens
agaattacgtgcaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggactactggaacagccagaaggacctcctggaggagaagcgggcagtgccggacaggatgtgcagacacaactacgagctggacgaggccgtgaccctgcagcgccgag

SEQ ID NO: 2117 - DNA, 264 bp, Homo sapiens
agaattacgtgtaccagttacggcaggaatgctacgcgtttaatgggacacagcgcttcctggagagatacatctacaaccgggaggagttcgcgcgcttcgacagcgacgtgggggagttccgggcggtgacggagctggggcggcctgatgaggactactggaacagccagaaggacctcctggaggagaagcgggcagtgccggacagggtatgcagacacaactacgagctggacgaggccgtgaccctgcagcgccgag

SEQ ID NO: 2118 - DNA, 264 bp, Homo sapiens
agaattacgtgtaccagttacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggaggagcgggcagtgccggacaggatgtgcagacacaactacgagctggacgaggccgtgaccctgcagcgccgag

SEQ ID NO: 2119 - DNA, 264 bp, Homo sapiens
agaattaccttttccagggacggcaggaatgctacgcgtttaatgggacacagcgcttcctggagagatacatctacaaccgggaggagtacgcgcgcttcgacagcgacgtgggggagttccgggcggtgacggagctggggcggcctgctgcggagtactggaacagccagaagcacatcctggaggagaagcgggcagtgccggacaggatgtgcagacacaactacgagctgggcgggcccatgaccctgcagcgccgag

SEQ ID NO: 2120 - DNA, 18 bp, Homo sapiens
acgcatagaccaacaggg

SEQ ID NO: 2121 - DNA, 23 bp, Homo sapiens
agtttatgtttgaatttgatgaa

SEQ ID NO: 2122 - DNA, 18 bp, Homo sapiens
tctggaggagtttggcca

SEQ ID NO: 2123 - DNA, 19 bp, Homo sapiens
gacgcatagaccaacagga

SEQ ID NO: 2124 - DNA, 22 bp, Homo sapiens
gtttatgtttgaatttgatgac

SEQ ID NO: 2125 - DNA, 18 bp, Homo sapiens
cacactcaggccgccaat

SEQ ID NO: 2126 - DNA, 21 bp, Homo sapiens
ttctatgtggatctggataaa

SEQ ID NO: 2127 - DNA, 19 bp, Homo sapiens
ctggaggagtttggccaaa

SEQ ID NO: 2128 - DNA, 17 bp, Homo sapiens
ctggaggagtttggccg

SEQ ID NO: 2129 - DNA, 18 bp, Homo sapiens
gccgcgtttgtacagacc

SEQ ID NO: 2130 - DNA, 21 bp, Homo sapiens
tgaatttgatgaagatgagca

SEQ ID NO: 2131 - DNA, 20 bp, Homo sapiens
agttctatgtggatctggat

SEQ ID NO: 2132 - DNA, 19 bp, Homo sapiens
gacccatagaccaacagga

SEQ ID NO: 2133 - DNA, 19 bp, Homo sapiens
tgccatgtttgtacagacc

SEQ ID NO: 2134 - DNA, 19 bp, Homo sapiens
atgtgtcaacttatgccat

SEQ ID NO: 2135 - DNA, 20 bp, Homo sapiens
ctggctaacattgctatatc

SEQ ID NO: 2136 - DNA, 20 bp, Homo sapiens
catgtgtcaacttatgccat

SEQ ID NO: 2137 - DNA, 21 bp, Homo sapiens
aacaacaacttgaatatcgct

SEQ ID NO: 2138 - DNA, 16 bp, Homo sapiens
gcagtgccggacaggg

SEQ ID NO: 2139 - DNA, 17 bp, Homo sapiens
cagtgccggacagggta

SEQ ID NO: 2140 - DNA, 17 bp, Homo sapiens
tcgacagcgacgtggga

SEQ ID NO: 2141 - DNA, 18 bp, Homo sapiens
caaccgggaggagttcgt

SEQ ID NO: 2142 - DNA, 17 bp, Homo sapiens
ctggggcggcctgatga

SEQ ID NO: 2143 - DNA, 17 bp, Homo sapiens
ggacatcctggaggagg

SEQ ID NO: 2144 - DNA, 17 bp, Homo sapiens
cagtgccggacaggatg

SEQ ID NO: 2145 - DNA, 18 bp, Homo sapiens
acacaactacgagctggg

SEQ ID NO: 2146 - DNA, 16 bp, Homo sapiens
gctggggcggcctgac

SEQ ID NO: 2147 - DNA, 17 bp, Homo sapiens
aggaggagcgggcagtt

SEQ ID NO: 2148 - DNA, 20 bp, Homo sapiens
gatacatctacaaccgggaa

SEQ ID NO: 2149 - DNA, 19 bp, Homo sapiens
ctacaaccgggaggagttt

SEQ ID NO: 2150 - DNA, 17 bp, Homo sapiens
ctacaaccgggaggagc

SEQ ID NO: 2151 - DNA, 16 bp, Homo sapiens
gctggggcggcctgag

SEQ ID NO: 2152 - DNA, 16 bp, Homo sapiens
gagctgggcgggccca

SEQ ID NO: 2153 - DNA, 19 bp, Homo sapiens
agaattacgtgtaccagtt

SEQ ID NO: 2154 - DNA, 17 bp, Homo sapiens
ggcggcctgatgaggac

SEQ ID NO: 2155 - DNA, 18 bp, Homo sapiens
ggaacagccagaaggacc

SEQ ID NO: 2156 - DNA, 17 bp, Homo sapiens
acgaggccgtgacccta

SEQ ID NO: 2157 - DNA, 18 bp, Homo sapiens
ctacaaccgggaggagtt

SEQ ID NO: 2158 - DNA, 17 bp, Homo sapiens
aaccgggaggagctcgt

SEQ ID NO: 2159 - DNA, 17 bp, Homo sapiens
ggacctcctggaggagg

SEQ ID NO: 2160 - DNA, 19 bp, Homo sapiens
agaattacgtgcaccagtt

SEQ ID NO: 2161 - DNA, 19 bp, Homo sapiens
agatacatctacaaccggc

SEQ ID NO: 2162 - DNA, 20 bp, Homo sapiens
ggagagatacatctacaaca

SEQ ID NO: 2163 - DNA, 17 bp, Homo sapiens
ggcagtgccggacagga

SEQ ID NO: 2164 - DNA, 16 bp, Homo sapiens
gagctggtcgggccca

SEQ ID NO: 2165 - DNA, 19 bp, Homo sapiens
gacacaactacgagctggt

SEQ ID NO: 2166 - DNA, 17 bp, Homo sapiens
ccgtgaccctgcagcgt

SEQ ID NO: 2167 - DNA, 17 bp, Homo sapiens
gggcagtgccggacaga

SEQ ID NO: 2168 - DNA, 17 bp, Homo sapiens
ggaggagaagcgggcat

SEQ ID NO: 2169 - DNA, 17 bp, Homo sapiens
gggcggcctgatgaggt

SEQ ID NO: 2170 - DNA, 18 bp, Homo sapiens
gacggcaggaatgctacc

SEQ ID NO: 2171 - DNA, 18 bp, Homo sapiens
ggaacagccagaaggact

SEQ ID NO: 2172 - DNA, 17 bp, Homo sapiens
ggacttcctggaggagg

SEQ ID NO: 2173 - DNA, 19 bp, Homo sapiens
ggaacagccagaaggacaa

SEQ ID NO: 2174 - DNA, 18 bp, Homo sapiens
gccagaaggacctcctgt

SEQ ID NO: 2175 - DNA, 17 bp, Homo sapiens
gacctcctggaggagag

SEQ ID NO: 2176 - DNA, 20 bp, Homo sapiens
aattaccttttccagggact

SEQ ID NO: 2177 - DNA, 17 bp, Homo sapiens
gagaagcgggcagtgct

SEQ ID NO: 2178 - DNA, 17 bp, Homo sapiens
cccatgaccctgcagca

SEQ ID NO: 2179 - DNA, 16 bp, Homo sapiens
tggggcggcctgagga

SEQ ID NO: 2180 - DNA, 17 bp, Homo sapiens
gccgtgaccctgcagca

SEQ ID NO: 2181 - DNA, 18 bp, Homo sapiens
gaattacgtgcaccagtt

SEQ ID NO: 2182 - DNA, 18 bp, Homo sapiens
actggaacagccagaagc

SEQ ID NO: 2183 - DNA, 19 bp, Homo sapiens
accaacaggggagtttatg

SEQ ID NO: 2184 - DNA, 21 bp, Homo sapiens
gaatttgatgaagatgagatg

SEQ ID NO: 2185 - DNA, 19 bp, Homo sapiens
agtttggccaagccttttc

SEQ ID NO: 2186 - DNA, 20 bp, Homo sapiens
gaccaacaggagagtttatg

SEQ ID NO: 2187 - DNA, 21 bp, Homo sapiens
gaatttgatgacgatgagatg

SEQ ID NO: 2188 - DNA, 20 bp, Homo sapiens
atctggataaaaaggagacc

SEQ ID NO: 2189 - DNA, 20 bp, Homo sapiens
tttggccaaaccttttcctt

SEQ ID NO: 2190 - DNA, 19 bp, Homo sapiens
agtttggccgagccttttc

SEQ ID NO: 2191 - DNA, 19 bp, Homo sapiens
tgtacagacccatagacca

SEQ ID NO: 2192 - DNA, 20 bp, Homo sapiens
gaagatgagcagttctatgt

SEQ ID NO: 2193 - DNA, 20 bp, Homo sapiens
cgtttgtacaaacccataga

SEQ ID NO: 2194 - DNA, 19 bp, Homo sapiens
ggatctggataagaaggag

SEQ ID NO: 2195 - DNA, 21 bp, Homo sapiens
acttatgccatgtttgtacag

SEQ ID NO: 2196 - DNA, 21 bp, Homo sapiens
attgctatatcgaacaacaac

SEQ ID NO: 2197 - DNA, 19 bp, Homo sapiens
gaatatcgctatccagcgt

SEQ ID NO: 2198 - DNA, 17 bp, Homo sapiens
taccagggacggcagga

SEQ ID NO: 2199 - DNA, 18 bp, Homo sapiens
ccggacagggtatgcaga

SEQ ID NO: 2200 - DNA, 18 bp, Homo sapiens
ggacagggtatgcagaca

SEQ ID NO: 2201 - DNA, 17 bp, Homo sapiens
gacgtgggagagttccg

SEQ ID NO: 2202 - DNA, 19 bp, Homo sapiens
attaccttttccagggacg

SEQ ID NO: 2203 - DNA, 17 bp, Homo sapiens
ggagttcgtgcgcttcg

SEQ ID NO: 2204 - DNA, 18 bp, Homo sapiens
ggcctgatgaggagtact

SEQ ID NO: 2205 - DNA, 16 bp, Homo sapiens
ggaggaggagcgggca

SEQ ID NO: 2206 - DNA, 18 bp, Homo sapiens
ggacaggatgtgcagaca

SEQ ID NO: 2207 - DNA, 15 bp, Homo sapiens
gagctgggcgggccc

SEQ ID NO: 2208 - DNA, 17 bp, Homo sapiens
cggcctgacgaggagta

SEQ ID NO: 2209 - DNA, 17 bp, Homo sapiens
cgggcagttccggacag

SEQ ID NO: 2210 - DNA, 18 bp, Homo sapiens
caaccgggaagagttcgt

SEQ ID NO: 2211 - DNA, 18 bp, Homo sapiens
ggaggagtttgtgcgctt

SEQ ID NO: 2212 - DNA, 16 bp, Homo sapiens
ggaggagctcgtgcgc

SEQ ID NO: 2213 - DNA, 16 bp, Homo sapiens
cggcctgaggcggagt

SEQ ID NO: 2214 - DNA, 16 bp, Homo sapiens
cgggcccatgaccctg

SEQ ID NO: 2215 - DNA, 18 bp, Homo sapiens
tgtaccagttacggcagg

SEQ ID NO: 2216 - DNA, 19 bp, Homo sapiens
tgatgaggactactggaac

SEQ ID NO: 2217 - DNA, 18 bp, Homo sapiens
cagaaggacctcctggag

SEQ ID NO: 2218 - DNA, 17 bp, Homo sapiens
gtgaccctacagcgccg

SEQ ID NO: 2219 - DNA, 16 bp, Homo sapiens
ggaggagttcgcgcgc

SEQ ID NO: 2220 - DNA, 17 bp, Homo sapiens
ggagctcgtgcgcttcg

SEQ ID NO: 2221 - DNA, 20 bp, Homo sapiens
aattacgtgcaccagttacg

SEQ ID NO: 2222 - DNA, 18 bp, Homo sapiens
tacaaccggcaggagtac

SEQ ID NO: 2223 - DNA, 19 bp, Homo sapiens
atctacaacaggcaggagt

SEQ ID NO: 2224 - DNA, 18 bp, Homo sapiens
ccggacaggatatgcaga

SEQ ID NO: 2225 - DNA, 16 bp, Homo sapiens
cgagctggtcgggccc

SEQ ID NO: 2226 - DNA, 18 bp, Homo sapiens
gccggacagagtatgcag

SEQ ID NO: 2227 - DNA, 17 bp, Homo sapiens
gcaccagttacggcagg

SEQ ID NO: 2228 - DNA, 16 bp, Homo sapiens
gcgggcattgccggac

SEQ ID NO: 2229 - DNA, 19 bp, Homo sapiens
ctgatgaggtgtactggaa

SEQ ID NO: 2230 - DNA, 20 bp, Homo sapiens
gaatgctacccgtttaatgg

SEQ ID NO: 2231 - DNA, 18 bp, Homo sapiens
cagaaggacttcctggag

SEQ ID NO: 2232 - DNA, 18 bp, Homo sapiens
agaaggacaacctggagg

SEQ ID NO: 2233 - DNA, 18 bp, Homo sapiens
gacctcctgtaggagaag

SEQ ID NO: 2234 - DNA, 16 bp, Homo sapiens
ggaggagaggcgggca

SEQ ID NO: 2235 - DNA, 17 bp, Homo sapiens
ggaccagttacggcagg

SEQ ID NO: 2236 - DNA, 18 bp, Homo sapiens
tccagggactgcaggaat

SEQ ID NO: 2237 - DNA, 17 bp, Homo sapiens
ggcagtgctggacaggg

SEQ ID NO: 2238 - DNA, 16 bp, Homo sapiens
gctgggcgggcccatg

SEQ ID NO: 2239 - DNA, 17 bp, Homo sapiens
cggcctgaggaggagta

SEQ ID NO: 2240 - DNA, 18 bp, Homo sapiens
ggcctgaggaggagtact

SEQ ID NO: 2241 - DNA, 18 bp, Homo sapiens
agccagaagcacatcctg

SEQ ID NO: 2242 - DNA, 23 bp, Homo sapiens
aaacacggtcacctcagggggat

SEQ ID NO: 2243 - DNA, 21 bp, Homo sapiens
ggcctgagtgtggttggaacg

SEQ ID NO: 2244 - DNA, 22 bp, Homo sapiens
ccagctcgtagttgtgtctgca

SEQ ID NO: 2245 - DNA, 39 bp, Homo sapiens; identical to SEQ ID NO: 1995

SEQ ID NO: 2246 - DNA, 2 bp, Homo sapiens
aa

SEQ ID NO: 2247 - DNA, 17 bp, Homo sapiens
agaattaccttttccag

SEQ ID NO: 2248 - DNA, 17 bp, Homo sapiens
agaattacgttttccag

SEQ ID NO: 2249 - DNA, 20 bp, Homo sapiens
tgaatttgatggagatgagg

SEQ ID NO: 2250 - DNA, 18 bp, Homo sapiens
ggtgcttccagacaccag

SEQ ID NO: 2251 - DNA, 18 bp, Homo sapiens
ggttgtctgtgggcctca

SEQ ID NO: 2252 - DNA, 18 bp, Homo sapiens
cagcccaacaccctcatc

SEQ ID NO: 2253 - DNA, 17 bp, Homo sapiens
gctgagcaatgggcacg

SEQ ID NO: 2254 - DNA, 18 bp, Homo sapiens
cagagactgtggtctgca

SEQ ID NO: 2255 - DNA, 18 bp, Homo sapiens
cccttgtggaggtgaagg

SEQ ID NO: 2256 - DNA, 18 bp, Homo sapiens
cctgtggtcaacatcacc

SEQ ID NO: 2257 - DNA, 17 bp, Homo sapiens
ccctgtggaggtgaagg

SEQ ID NO: 2258 - DNA, 17 bp, Homo sapiens
cctggagaggaaggagg

SEQ ID NO: 2259 - DNA, 18 bp, Homo sapiens
tgcctctgttccacagac

SEQ ID NO: 2260 - DNA, 15 bp, Homo sapiens
agcctgagattccaa

SEQ ID NO: 2261 - DNA, 17 bp, Homo sapiens
gccctgaccaccgtgac

SEQ ID NO: 2262 - DNA, 18 bp, Homo sapiens
caccttcctcccttctga

SEQ ID NO: 2263 - DNA, 20 bp, Homo sapiens
ttaaacgctccaactctact

SEQ ID NO: 2264 - DNA, 17 bp, Homo sapiens
ccagacaccaagggccc

SEQ ID NO: 2265 - DNA, 20 bp, Homo sapiens
cagtgttttccaagtctcct

SEQ ID NO: 2266 - DNA, 17 bp, Homo sapiens
gcactggggcctggaca

SEQ ID NO: 2267 - DNA, 16 bp, Homo sapiens
ggtctgcgccctggga

SEQ ID NO: 2268 - DNA, 19 bp, Homo sapiens
ctgaccacgttgcctctta

SEQ ID NO: 2269 - DNA, 22 bp, Homo sapiens
cctaaaacataacttgaacagt

SEQ ID NO: 2270 - DNA, 21 bp, Homo sapiens
cagacaatttagatttgaccg

SEQ ID NO: 2271 - DNA, 18 bp, Homo sapiens
tcaccctcctcccttctt

SEQ ID NO: 2272 - DNA, 19 bp, Homo sapiens
tgtaccagtcttacggtct

SEQ ID NO: 2273 - DNA, 17 bp, Homo sapiens
aggtggagcactgggga

SEQ ID NO: 2274 - DNA, 17 bp, Homo sapiens
ggtccctctggccagtt

SEQ ID NO: 2275 - DNA, 17 bp, Homo sapiens
ccaagtctcccgtgacg

SEQ ID NO: 2276 - DNA, 18 bp, Homo sapiens
gcactgacaaacatcgcc

SEQ ID NO: 2277 - DNA, 16 bp, Homo sapiens
gggggtgtaccgggca

SEQ ID NO: 2278 - DNA, 16 bp, Homo sapiens
cgcaggggcggcctgt

SEQ ID NO: 2279 - DNA, 15 bp, Homo sapiens
agggggcccgggcgt

SEQ ID NO: 2280 - DNA, 16 bp, Homo sapiens
gggcgtcggtggacag

SEQ ID NO: 2281 - DNA, 17 bp, Homo sapiens
gggcgtcggtggacaga

SEQ ID NO: 2282 - DNA, 20 bp, Homo sapiens
cagatttctatccaagccac

SEQ ID NO: 2283 - DNA, 17 bp, Homo sapiens
gcgacgtgggggtgtat

SEQ ID NO: 2284 - DNA, 16 bp, Homo sapiens
cgcaggggcggcctag

SEQ ID NO: 2285 - DNA, 16 bp, Homo sapiens
gcaggggcggcctagc

SEQ ID NO: 2286 - DNA, 16 bp, Homo sapiens
cgcaggggcggcctga

SEQ ID NO: 2287 - DNA, 16 bp, Homo sapiens
gcaggggcggcctgac

SEQ ID NO: 2288 - DNA, 18 bp, Homo sapiens
gaaggacatcctggagga

SEQ ID NO: 2289 - DNA, 19 bp, Homo sapiens
ggacatcctggagaggaaa

SEQ ID NO: 2290 - DNA, 17 bp, Homo sapiens
ctccccagcgtggagac

SEQ ID NO: 2291 - DNA, 18 bp, Homo sapiens
ccggtggtttcggaatgg

SEQ ID NO: 2292 - DNA, 17 bp, Homo sapiens
ctgctggggctgcctga

SEQ ID NO: 2293 - DNA, 18 bp, Homo sapiens
cttcgacagcgacgtgga

SEQ ID NO: 2294 - DNA, 16 bp, Homo sapiens
cgctggggccgcctga

SEQ ID NO: 2295 - DNA, 17 bp, Homo sapiens
ctccccagcatggagac

SEQ ID NO: 2296 - DNA, 17 bp, Homo sapiens
caccccagcctccagaa

SEQ ID NO: 2297 - DNA, 18 bp, Homo sapiens
aaccgagaggagtacgca

SEQ ID NO: 2298 - DNA, 15 bp, Homo sapiens
gctggggccgcctgc

SEQ ID NO: 2299 - DNA, 16 bp, Homo sapiens
aggacccgggcggagt

SEQ ID NO: 2300 - DNA, 18 bp, Homo sapiens
cctccagaaccccatcat

SEQ ID NO: 2301 - DNA, 16 bp, Homo sapiens
cggagcgcgtgcgtct

SEQ ID NO: 2302 - DNA, 15 bp, Homo sapiens
gacgccgctggggcc

SEQ ID NO: 2303 - DNA, 19 bp, Homo sapiens
cagaaggaagtcctggaga

SEQ ID NO: 2304 - DNA, 18 bp, Homo sapiens
tacttcaccaacgggacc

SEQ ID NO: 2305 - DNA, 17 bp, Homo sapiens
cgggcggagttggacac

SEQ ID NO: 2306 - DNA, 17 bp, Homo sapiens
cgtcggtggacaccgta

SEQ ID NO: 2307 - DNA, 17 bp, Homo sapiens
gtgggggtgtatcgggt

SEQ ID NO: 2308 - DNA, 17 bp, Homo sapiens
tgactccccagcatgcc

SEQ ID NO: 2309 - DNA, 18 bp, Homo sapiens
ggaaatgactccccagca

SEQ ID NO: 2310 - DNA, 19 bp, Homo sapiens
ggaacagccagaaggaaga

SEQ ID NO: 2311 - DNA, 17 bp, Homo sapiens
accaacgggaccgagct

SEQ ID NO: 2312 - DNA, 15 bp, Homo sapiens
gccgctggggcggct

SEQ ID NO: 2313 - DNA, 20 bp, Homo sapiens
ccatgtgctacttcaccaat

SEQ ID NO: 2314 - DNA, 17 bp, Homo sapiens
tgtatcgggcggtgacc

SEQ ID NO: 2315 - DNA, 19 bp, Homo sapiens
gtttcggaatgaccaggaa

SEQ ID NO: 2316 - DNA, 19 bp, Homo sapiens
gtgcgtcttgtgaccagat

SEQ ID NO: 2317 - DNA, 17 bp, Homo sapiens
ggcgttccgcgggatct

SEQ ID NO: 2318 - DNA, 19 bp, Homo sapiens
taggaatggtgactggact

SEQ ID NO: 2319 - DNA, 18 bp, Homo sapiens
gagcgcgtgcgtcttgta

SEQ ID NO: 2320 - DNA, 19 bp, Homo sapiens
caggccagatcaaagtcca

SEQ ID NO: 2321 - DNA, 16 bp, Homo sapiens
cgtgggggtgtaccgc

SEQ ID NO: 2322 - DNA, 18 bp, Homo sapiens
aggaagtcctggagagga

SEQ ID NO: 2323 - DNA, 18 bp, Homo sapiens
acacaactacgaggtggg

SEQ ID NO: 2324 - DNA, 19 bp, Homo sapiens
gtgcgtcttgtaaccagat

SEQ ID NO: 2325 - DNA, 16 bp, Homo sapiens
gcaggggcggcctgtc

SEQ ID NO: 2326 - DNA, 18 bp, Homo sapiens
caactacgaggtggcgtt

SEQ ID NO: 2327 - DNA, 17 bp, Homo sapiens
gcggcctgatgccgaga

SEQ ID NO: 2328 - DNA, 16 bp, Homo sapiens
gggcggtgacgccgct

SEQ ID NO: 2329 - DNA, 16 bp, Homo sapiens
cgctggggcggcctga

SEQ ID NO: 2330 - DNA, 16 bp, Homo sapiens
gggacccgggcggagt

SEQ ID NO: 2331 - DNA, 19 bp, Homo sapiens
ggagatgaggagttctacg

SEQ ID NO: 2332 - DNA, 18 bp, Homo sapiens
cagacaccaggggccatt

SEQ ID NO: 2333 - DNA, 18 bp, Homo sapiens
gtgggcctcatgggcatt

SEQ ID NO: 2334 - DNA, 19 bp, Homo sapiens
caccctcatctgtcttgtg

SEQ ID NO: 2335 - DNA, 18 bp, Homo sapiens
aatgggcacgcagtcaca

SEQ ID NO: 2336 - DNA, 16 bp, Homo sapiens
ggtctgcaccctgggg

SEQ ID NO: 2337 - DNA, 18 bp, Homo sapiens
gaggtgaaggcattgtgg

SEQ ID NO: 2338 - DNA, 18 bp, Homo sapiens
caacatcacctggctgag

SEQ ID NO: 2339 - DNA, 17 bp, Homo sapiens
ggaaggaggctgcctgg

SEQ ID NO: 2340 - DNA, 23 bp, Homo sapiens
ctgttccacagacttagaccttt

SEQ ID NO: 2341 - DNA, 20 bp, Homo sapiens
gagattccaacacctatgtc

SEQ ID NO: 2342 - DNA, 17 bp, Homo sapiens
caccgtgacgagccctt

SEQ ID NO: 2343 - DNA, 20 bp, Homo sapiens
ctcccttctgatgatgagat

SEQ ID NO: 2344 - DNA, 19 bp, Homo sapiens
caactctactgctgctacc

SEQ ID NO: 2345 - DNA, 17 bp, Homo sapiens
catcatccgaggcctgc

SEQ ID NO: 2346 - DNA, 18 bp, Homo sapiens
caagtctcctgtgacgct

SEQ ID NO: 2347 - DNA, 18 bp, Homo sapiens
ggcctggacaagcctctt

SEQ ID NO: 2348 - DNA, 18 bp, Homo sapiens
cgccctgggattgtctgt

SEQ ID NO: 2349 - DNA, 20 bp, Homo sapiens
gttgcctcttatggtgtaaa

SEQ ID NO: 2350 - DNA, 22 bp, Homo sapiens
aacttgaacagtctgattaaac

SEQ ID NO: 2351 - DNA, 22 bp, Homo sapiens
acgtttgaccggcaatttgcac

SEQ ID NO: 2352 - DNA, 18 bp, Homo sapiens
ctcccttcttctgaggag

SEQ ID NO: 2353 - DNA, 18 bp, Homo sapiens
cttacggtctctctggcc

SEQ ID NO: 2354 - DNA, 18 bp, Homo sapiens
gcactggggactggacaa

SEQ ID NO: 2355 - DNA, 18 bp, Homo sapiens
ctggccagttcacccatg

SEQ ID NO: 2356 - DNA, 16 bp, Homo sapiens
cccgtgacgctgggtc

SEQ ID NO: 2357 - DNA, 20 bp, Homo sapiens
caaacatcgccgtgacaaaa

SEQ ID NO: 2358 - DNA, 17 bp, Homo sapiens
taccgggcagtgacgcc

SEQ ID NO: 2359 - DNA, 16 bp, Homo sapiens
gcggcctgttgccgag

SEQ ID NO: 2360 - DNA, 16 bp, Homo sapiens
ccgggcgtcggtggac

SEQ ID NO: 2361 - DNA, 17 bp, Homo sapiens
ggtggacagggtgtgca

SEQ ID NO: 2362 - DNA, 18 bp, Homo sapiens
ggtggacagagtgtgcag

SEQ ID NO: 2363 - DNA, 19 bp, Homo sapiens
tccaagccacatcaaagtc

SEQ ID NO: 2364 - DNA, 16 bp, Homo sapiens
ggggtgtatcgggcgg

SEQ ID NO: 2365 - DNA, 16 bp, Homo sapiens
gcggcctagcgccgag

SEQ ID NO: 2366 - DNA, 16 bp, Homo sapiens
cggcctagcgccgagt

SEQ ID NO: 2367 - DNA, 16 bp, Homo sapiens
gcggcctgacgccgag

SEQ ID NO: 2368 - DNA, 16 bp, Homo sapiens
cggcctgacgccgagt

SEQ ID NO: 2369 - DNA, 16 bp, Homo sapiens
gcggcctgatgccgag

SEQ ID NO: 2370 - DNA, 16 bp, Homo sapiens
cctggaggaggaccgg

SEQ ID NO: 2371 - DNA, 17 bp, Homo sapiens
gagaggaaacgggcggc

SEQ ID NO: 2372 - DNA, 18 bp, Homo sapiens
gcgtggagacgtctacac

SEQ ID NO: 2373 - DNA, 17 bp, Homo sapiens
tcggaatggccaggagg

SEQ ID NO: 2374 - DNA, 16 bp, Homo sapiens
gctgcctgacgccgag

SEQ ID NO: 2375 - DNA, 17 bp, Homo sapiens
cgacgtggaggtgtacc

SEQ ID NO: 2376 - DNA, 16 bp, Homo sapiens
gccgcctgacgccgag

SEQ ID NO: 2377 - DNA, 18 bp, Homo sapiens
gcatggagacgtctacac

SEQ ID NO: 2378 - DNA, 18 bp, Homo sapiens
gcctccagaaccccatca

SEQ ID NO: 2379 - DNA, 18 bp, Homo sapiens
ggagtacgcacgcttcga

SEQ ID NO: 2380 - DNA, 15 bp, Homo sapiens
ccgcctgccgccgag

SEQ ID NO: 2381 - DNA, 17 bp, Homo sapiens
gggcggagttggacacg

SEQ ID NO: 2382 - DNA, 18 bp, Homo sapiens
accccatcatcgtggagt

SEQ ID NO: 2383 - DNA, 18 bp, Homo sapiens
gcgtgcgtcttgtgacca

SEQ ID NO: 2384 - DNA, 16 bp, Homo sapiens
gctggggccgcctgac

SEQ ID NO: 2385 - DNA, 16 bp, Homo sapiens
cctggagaggacccgg

SEQ ID NO: 2386 - DNA, 16 bp, Homo sapiens
aacgggaccgagcgcg

SEQ ID NO: 2387 - DNA, 18 bp, Homo sapiens
agttggacacggtgtgca

SEQ ID NO: 2388 - DNA, 18 bp, Homo sapiens
ggacaccgtatgcagaca

SEQ ID NO: 2389 - DNA, 17 bp, Homo sapiens
gtatcgggtggtgacgc

SEQ ID NO: 2390 - DNA, 19 bp, Homo sapiens
cccagcatgccgtgtctac

SEQ ID NO: 2391 - DNA, 17 bp, Homo sapiens
tccccagcatggagacg

SEQ ID NO: 2392 - DNA, 19 bp, Homo sapiens
agaaggaagacctggagag

SEQ ID NO: 2393 - DNA, 16 bp, Homo sapiens
gaccgagctcgtgcgg

SEQ ID NO: 2394 - DNA, 16 bp, Homo sapiens
ggggcggcttgacgcc

SEQ ID NO: 2395 - DNA, 18 bp, Homo sapiens
cttcaccaatgggacgga

SEQ ID NO: 2396 - DNA, 16 bp, Homo sapiens
gcggtgaccccgcagg

SEQ ID NO: 2397 - DNA, 18 bp, Homo sapiens
tgaccaggaagagacagc

SEQ ID NO: 2398 - DNA, 21 bp, Homo sapiens
tgtgaccagatacatctataa

SEQ ID NO: 2399 - DNA, 17 bp, Homo sapiens
gcgggatcttgcagagg

SEQ ID NO: 2400 - DNA, 19 bp, Homo sapiens
tgactggactttccagatc

SEQ ID NO: 2401 - DNA, 19 bp, Homo sapiens
gcgtcttgtaaccagacac

SEQ ID NO: 2402 - DNA, 19 bp, Homo sapiens
tcaaagtccagtggtttcg

SEQ ID NO: 2403 - DNA, 17 bp, Homo sapiens
gtgtaccgcgcggtgac

SEQ ID NO: 2404 - DNA, 16 bp, Homo sapiens
ggagaggacccgggcg

SEQ ID NO: 2405 - DNA, 16 bp, Homo sapiens
cgaggtggggtaccgc

SEQ ID NO: 2406 - DNA, 19 bp, Homo sapiens
gcgtcttgtaaccagatac

SEQ ID NO: 2407 - DNA, 22 bp, Homo sapiens
tgtaaccagatacatctataac

SEQ ID NO: 2408 - DNA, 16 bp, Homo sapiens
cggcctgtcgccgagt

SEQ ID NO: 2409 - DNA, 16 bp, Homo sapiens
ccgggcggagttggac

SEQ ID NO: 2410 - DNA, 16 bp, Homo sapiens
ggtggcgttccgcggg

SEQ ID NO: 2411 - DNA, 18 bp, Homo sapiens
gatgccgagaactggaac

SEQ ID NO: 2412 - DNA, 15 bp, Homo sapiens
acgccgctggggcgg

SEQ ID NO: 2413 - DNA, 19 bp, Homo sapiens
ggtgaggtaactgatcttg

SEQ ID NO: 2414 - DNA, 23 bp, Homo sapiens
tccttctggctgttccagtactc

SEQ ID NO: 2415 - DNA, 21 bp, Homo sapiens
atgatcctaaacaaagctctg

SEQ ID NO: 2416 - DNA, 23 bp, Homo sapiens
tgtgctacttcaccaacgggacg

SEQ ID NO: 2417 - DNA, 768 bp, Homo sapiens
atgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgaggagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgcgccctggggttgtctgtgggcctcgtgggcattgtggtgggcactgtcttcatcatccaaggcctgcgttcagttggtgcttccagacaccaagggccattgtga

SEQ ID NO: 2418 - DNA, 768 bp, Homo sapiens
atgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgaggagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgcgccctggggttgtctgtgggcctcgtgggcattgtggtgggcactgtcttcatcatccaaggcctgcgttcagttggtgcttccagacaccaggggccattgtga

SEQ ID NO: 2419 - DNA, 768 bp, Homo sapiens
atgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtga

SEQ ID NO: 2420 - DNA, 768 bp, Homo sapiens
atgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatctgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtga

SEQ ID NO: 2421 - DNA, 768 bp, Homo sapiens
atgatcctaaacaaagctctgctgctgggggccctcgctctgaccaccgtgatgagcccctgtggaggtgaagacattgtggctgaccatgttgcctcttgtggtgtaaacttgtaccagttttacggtccctctggccagttcacccatgaatttgatggagatgagcagttctacgtggacctggagaagaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatctgtcttgtggacaacatctttcctcctgtggtcaacatcacatggctgagcaatgggcacgcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcgtgggcattgtggtgggcactgtcttcatcatccaaggcctgcgttcagttggtgcttccagacaccaagggcccttgtga

SEQ ID NO: 2422 - DNA, 768 bp, Homo sapiens
atgatcctaaacaaagctctgctgctgggggccctcgctctgaccaccatgatgagcccttgtggaggtgaaggcattgtggctgaccacgttgcctcttgtggtgtaaacttgtaccagttttacggtccctctggccagtacacccatgaatttgatggagatgaggagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgcaccctggggttgtctgtgggcctcgtgggcattgtggtgggcactgtcttcatcatccaaggcctgcgttcagttggtgcttccagacaccaagggccattgtga

SEQ ID NO: 2423 - DNA, 613 bp, Homo sapiens
atgatcctaaacaaagctctgctgctgggggccctcgctctgaccaccatgatgagcccttgtggaggtgaaggcattgtggctgaccacgttgcctcttgtggtgtaaacttgtaccagttttacggtccctctggccagtacacccatgaatttgatggagatgaggagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacctggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactggg

SEQ ID NO: 2424 - DNA, 750 bp, Homo sapiens
atgatcctaaacaaagctctgctgctgggggccctcgctctgaccaccatgatgagcccctgtggaggtgaaggcattgtggctgaccacgttgcctcttgtggtgtaaacttgtaccagttttacggtccctctggccagtacacccatgaatttgatggagatgaggagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgcgccctggggttgtctgtgggcctcgtgggcattgtggtgggcactgtcttcatcatccaaggcctgcgttcagttggtgcttccaga

SEQ ID NO: 2425 - DNA, 249 bp, Homo sapiens
ctgaccacgttgcctcttgtggtgtaaacttgtaccagttttacggtccctctggccagtacacccatgaatttgatggagatgagcagttctacgtggacctggagaggaaggaggctgcctggcggtggcctgagttcagcaaatttggaggttttgacccgcagggtgcactgagaaacatggctgtggcaaaacacaacttgaacatcatgattaaacgctacaactctaccgctgctaccaatg

SEQ ID NO: 2426 - DNA, 765 bp, Homo sapiens
atgatcctaaacaaagctctgatgctgggggccctcgccctgaccaccgtgatgagcccttgtggaggtgaagacattgtggctgaccacgttgcctcttacggtgtaaacttgtaccagtcttacggtccctctggccagttcacccatgaatttgatggagacgaggagttctatgtggacctggagaggaaggagactgtctggaagttgcctctgttccacagacttagatttgacccgcaatttgcactgacaaacatcgctgtgctaaaacataacttgaacatcctgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccagcacctatgtcagagctcacagagactgtggtctgtgccctggggttgtctgtgggcctcgtgggcattgtggtggggaccgtcttgatcatccgaggcctgcgttcagttggtgcttccagacaccaagggcccttgtga

SEQ ID NO: 2427 - DNA, 768 bp, Homo sapiens
atgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtga

SEQ ID NO: 2428 - DNA, 768 bp, Homo sapiens
atgatcctaaacaaagctctgatgctgggggccctcgccctgaccaccgtgacgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgatgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtga

SEQ ID NO: 2429 - DNA, 768 bp, Homo sapiens
atgatcctaaacaaagctctgatgctgggggccctcgccctgaccaccgtgatgagcccttgtggaggtgaagacattgtggctgaccatgttgcctcttacggtgtaaacttgtaccagtcttatggtccctctgggcagtacagccatgaatttgatggagacgaggagttctatgtggacctggagaggaaggagactgtctggcagttgcctctgttccgcagatttagaagatttgacccgcaatttgcactgacaaacatcgctgtgctaaaacataacttgaacatcgtgattaaacgctccaactctaccgctgctaccaatgaggttcctgaggtcacagtgttttccaagtctcccgtgacactgggtcagcccaacaccctcatctgtcttgtggacaacatctttcctcctgtggtcaacatcacctggctgagcaatgggcactcagtcacagaaggtgtttctgagaccagcttcctctccaagagtgatcattccttcttcaagatcagttacctcaccttcctcccttctgatgatgagatttatgactgcaaggtggagcactggggcctggatgagcctcttctgaaacactgggagcctgagattccaacacctatgtcagagctcacagagactgtggtctgcgccctggggttgtctgtgggcctcgtgggcattgtggtggggaccgtcttgatcatccgaggcctgcgttcagttggtgcttccagacaccaagggcccttgtga

SEQ ID NO: 2430 - DNA, 765 bp, Homo sapiens
atgatcctaaacaaagctctgctgctgggggcccttgccctgaccaccgtgatgagcccctgtggaggtgaagacattgtggctgaccatgttgcctcttatggtgtaaacttgtaccagtcttacggtccctctggccagtacacccatgaatttgatggagacgagcagttctacgtggacctggggaggaaggagactgtctggtgtttgcctgttctcagacaatttagatttgacccgcaatttgcactgacaaacatcgctgtgacaaaacacaacttgaacatcctgattaaacgctccaactctactgctgctaccaatgaggttcctgaggtcacagtgttttccaagtctcccgtgacgctgggtcagcccaacaccctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtga

SEQ ID NO: 2431 - DNA, 528 bp, Homo sapiens
ctgaccatgttgcctcttatggtgtaaacttgtaccagtcttacggtccctctggccagtacacccatgaatttgatggagacgagcagttctacgtggacctggggaggaaggagactgtctggtgtttgcctgttctcagacaatttagatttgacccgcaatttgcactgacaaacatcgctgtgacaaaacacaacttgaacatcctgattaaacgctccaactctactgctgctaccaatgaggttcctgaggtcacagtgttttccaagtctcctgtgacgctgggtcagcccaacaccctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactggg

SEQ ID NO: 2432 - DNA, 765 bp, Homo sapiens
atgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtga

SEQ ID NO: 2433 - DNA, 258 bp, Homo sapiens
gaagacattgtggctgaccacgttgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaat

SEQ ID NO: 2434 - DNA, 222 bp, Homo sapiens
ggtgtaaacttgtaccagtcttacggtccctctggccagtacacccatgaatttgatggagatgagcagttctacgtggacctggggaggaaggagactgtctggtgtttgcctgttctcagacaatttagatttgaccggcaatttgcactgacaaacatcgctgtcctaaaacataacttgaacagtctgattaaacgctccaactctaccgctgctacc

SEQ ID NO: 2435 - DNA, 765 bp, Homo sapiens
atgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttcttctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtga

SEQ ID NO: 2436 - DNA, 246 bp, Homo sapiens
ctgaccacgtcgcctcttatggtgtaaacttgtaccagtcttacggtctctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatg

SEQ ID NO: 2437 - DNA, 765 bp, Homo sapiens
atgatcctaaacaaagctctgatgctggggacccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggactggacaagcctcttctgaaacactgggagcctgagattccagcccctatgtcagagctcacagagactgtggtctgcgccctggggttgtctgtgggcctcgtgggcattgtggtgggcactgtcttcatcatccgaggcctgcgttcagttggtgcttccagacaccaagggcccttgtga

SEQ ID NO: 2438 - DNA, 765 bp, Homo sapiens
atgatcctaaacaaagctctgctgctgggggcccttgccctgaccaccgtgatgagcccctgtggaggtgaagacattgtggctgaccatgttgcctcttatggtgtaaacttgtaccagtcttacggtccctctggccagttcacccatgaatttgatggagacgagcagttctacgtggacctggggaggaaggagactgtctggtgtttgcctgttctcagacaatttagatttgacccgcaatttgcactgacaaacatcgctgtgacaaaacacaacttgaacatcctgattaaacgctccaactctaccgctgctaccaatgaggttcctgaggtcacagtgttttccaagtctcccgtgacgctgggtcagcccaacaccctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccttcctcccttctgctgatgagatttatgactgcaaggtggagcactggggcctggacgagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtga

SEQ ID NO: 2439 - DNA, 227 bp, Homo sapiens
ggtgtaaacttgtaccagtcttacggtccctctggccagttcacccatgaatttgatggagacgagcagttctacgtggacctggggaggaaggagactgtctggtgtttgcctgttctcagacaatttagatttgacccgcaatttgcactgacaaacatcgccgtgacaaaacacaacttgaacatcctgattaaacgctccaactctaccgctgctaccaatga

SEQ ID NO: 2440 - DNA, 529 bp, Homo sapiens
gggcctgtgctacttcaccaacgggacggagcgcgtgcggggtgtgaccagacacatctataaccgagaggagtacgtgcgcttcgacagcgacgtgggggtgtaccgggcagtgacgccgcaggggcggcctgttgccgagtactggaacagccagaaggaagtcctggagggggcccgggcgtcggtggacagggtgtgcagacacaactacgaggtggcgtaccgcgggatcctgcagaggagagtggagcccacagtgaccatctccccatccaggacagaggccctcaaccaccacaacctgctgatctgctcggtgacagatttctatccaagccagatcaaagtccggtggtttcggaatgatcaggaggagacagccggcgttgtgtccacccccctcattaggaacggtgactggaccttccagatcctggtgatgctggaaatgactccccagcgtggagatgtctacacctgccacgtggagcaccccagcctccagagccccatcaccgtggagtgg

SEQ ID NO: 2441 - DNA, 244 bp, Homo sapiens
gggcctgtgctacttcaccaacgggacggagcgcgtgcggggtgtgaccagacacatctataaccgagaggagtacgtgcgcttcgacagcgacgtgggggtgtaccgggcggtgacgccgcaggggcggcctgttgccgagtactggaacagccagaaggaagtcctggagggggcccgggcgtcggtggacagagtgtgcagacacaactacgaggtggcgtaccgcgggatcctgcagagg

SEQ ID NO: 2442 - DNA, 529 bp, Homo sapiens
gggcctgtgctacttcaccaacgggacggagcgcgtgcggggtgtgaccagacacatctataaccgagaggagtacgtgcgcttcgacagcgacgtgggggtgtaccgggcggtgacgccgcaggggcggcctagcgccgagtactggaacagccagaaggaagtcctggagggggcccgggcgtcggtggacagagtgtgcagacacaactacgaggtggcgtaccgcgggatcctgcagaggagagtggagcccacagtgaccatctccccatccaggacagaggccctcaaccaccacaacctgctgatctgctcggtgacagatttctatccaagccacatcaaagtccggtggtttcggaatgatcaggaggagacagccggcgttgtgtccacccccctcattaggaacggtgactggaccttccagatcctggtgatgctggaaatgactccccagcgtggagatgtctacacctgccacgtggagcaccccagcctccagagccccatcaccgtggagtgg

SEQ ID NO: 2443 - DNA, 245 bp, Homo sapiens
gggcctgtgctacttcaccaacgggacggagcgcgtgcggggtgtgaccagacacatctataaccgagaggagtacgtgcgcttcgacagcgacgtgggggtgtatcgggcggtgacgccgcaggggcggcctagcgccgagtactggaacagccagaaggaagtcctggagggggcccgggcgtcggtggacagagtgtgcagacacaactacgaggtggcgtaccgcgggatcctgcagagga

SEQ ID NO: 2444 - DNA, 529 bp, Homo sapiens
gggcctgtgctacttcaccaacgggacggagcgcgtgcggggtgtgaccagacacatctataaccgagaggagtacgtgcgcttcgacagcgacgtgggggtgtatcgggcggtgacgccgcaggggcggcctgacgccgagtactggaacagccagaaggaagtcctggagggggcccgggcgtcggtggacagagtgtgcagacacaactacgaggtggcgtaccgcgggatcctgcagaggagagtggagcccacagtgaccatctccccatccaggacagaggccctcaaccaccacaacctgctgatctgctcggtgacagatttctatccaagccagatcaaagtccggtggtttcggaatgatcaggaggagacagccggcgttgtgtccacccccctcattaggaacggtgactggaccttccagatcctggtgatgctggaaatgactccccagcgtggagatgtctacacctgccacgtggagcaccccagcctccagagccccatcaccgtggagtgg

SEQ ID NO: 2445 - DNA, 148 bp, Homo sapiens
gacggagcgcgtgcggggtgtgaccagacacatctataaccgagaggagtacgtgcgcttcgacagcgacgtgggggtgtatcgggcggtgacgccgcaggggcggcctgatgccgagtactggaacagccagaaggaagtcctggag

SEQ ID NO: 2446 - DNA, 212 bp, Homo sapiens
gggcctgtgctacttcaccaacgggacggagcgcgtgcggggtgtgaccagatacatctataaccgagaagagtacgtgcgcttcgacagcgacgtgggggtgtaccgggcggtgacgccgcaggggcggcctagcgccgagtactggaacagccagaaggacatcctggaggaggaccgggcgtcggtggacagggtgtgcagacacaact

SEQ ID NO: 2447 - DNA, 529 bp, Homo sapiens
gggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatgaccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtgg

SEQ ID NO: 2448 - DNA, 529 bp, Homo sapiens
gggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgccgccgagtactggaacagccagaaggacatcctggagaggaaacgggcggcggtggacagggtgtgcagacacaactaccagttggagctccgcacgaccttgcagcggcgagtggagcccacagtgaccatctccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggagacgtctacacctgccacgtggagcaccccagcctccagagccccatcaccgtggagtgg

SEQ ID NO: 2449 - DNA, 449 bp, Homo sapiens
gggcatgtgctacttcaccaacgggacagagcgcgtgcgtcttgtgagcagaagcatctataaccgagaagagatcgtgcgcttcgacagcgacgtgggggagttccgggcggtgacgctgctggggctgcctgacgccgagtactggaacagccagaaggacatcctggagaggaaacgggcggcggtggacagggtgtgcagacacaactaccagttggagctccgcacgaccttgcagcggcgaccccatccaggacagaggccctcaaccaccacaacctgctggtctgctcggtgacagatttctatccagcccagatcaaagtccggtggtttcggaatggccaggaggagacagctggcgttgtgtccaccccccttattaggaatggtgactggaccttccagatcctggtgatgctggaaatgactccccagcgtggaga

SEQ ID NO: 2450 - DNA, 529 bp, Homo sapiens
ggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtgg

SEQ ID NO: 2451 - DNA, 248 bp, Homo sapiens
ggccatgtgctacttcaccaacgggacggagcgcgtgcgttatgtgaccagatacatctataaccgagaggagtacgcgcgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgag

SEQ ID NO: 2452 - DNA, 529 bp, Homo sapiens
gggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgccgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtgg

SEQ ID NO: 2453 - DNA, 529 bp, Homo sapiens
gggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtgg

SEQ ID NO: 2454 - DNA, 248 bp, Homo sapiens
gggcatgtgctacttcaccaacgggacggagcgcgtgcgtcttgtgaccagatacatctataaccgagaggagtacgcgcgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgag

SEQ ID NO: 2455 - DNA, 529 bp, Homo sapiens
ggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgccgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtgg

SEQ ID NO: 2456 - DNA, 529 bp, Homo sapiens
gggcatgtgctacttcaccaacgggaccgagcgcgtgcggggtgtgaccagatacatctataaccgagaggagtacgcgcgcttcgacagcgacgtgggggtgtatcgggcggtgacgccgctggggccgcctgccgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtgg

SEQ ID NO: 2457 - DNA, 248 bp, Homo sapiens
gggcatgtgctacttcaccaacgggacggagcgcgtgcggggtgtgaccagatacatctataaccgagaggagtacgcgcgcttcgacagcgacgtgggggtgtatcgggcggtgacgccgctggggccgcctgccgccgagtactggaacagccagaaggaagtcctggagaggacccgggcggagttggacacggtgtgcagacacaactaccagttggagctccgcacgaccttgcagcggcgag

SEQ ID NO: 2458 - DNA, 248 bp, Homo sapiens
gggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaatagccagaaggacatcctggaggaggaccgggcgtcggtggacaccgtatgcagacacaactaccagttggagctccgcacgaccttgcagcggcgag

SEQ ID NO: 2459 - DNA, 247 bp, Homo sapiens
gggcatgtgctacttcaccaacgggacggagcgcgtgcgtcttgtgaccagatacatctataaccgagaggagtacgcacgcttcgacagcgacgtgggggtgtatcgggtggtgacgccgctggggccgcctgccgccgagtactggaacagccagaaggaagtcctggagaggacccgggcggagttggacacggtgtgcagacacaactaccagttggagctccgcacgaccttgcagcggcga

SEQ ID NO: 2460 - DNA, 248 bp, Homo sapiens
gggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgccgccgagtactggaacagccagaaggaagtcctggaggggacccgggcggagttggacacggtgtgcagacacaactaccagttggagctccgcacgaccttgcagcggcgag

SEQ ID NO: 2461 - DNA, 526 bp, Homo sapiens
ggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatgccgtctacacctgccacgtggagcaccccagcctccagaaccccatcaccgtggagtgg

SEQ ID NO: 2462 - DNA, 529 bp, Homo sapiens
ggccatgtgctacttcaccaacgggacggagcgcgtgcgttatgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcatggagacgtctacacctgccacgtggagcaccccagcctccagaaccccatcaccgtggagtgg

SEQ ID NO: 2463 - DNA, 248 bp, Homo sapiens
gggcctgtgctacttcaccaacgggacggagcgcgtgcgtcttgtgaccagatacatctataaccgagaggagtacgcacgcttcgacagcgacgtgggggtgtatcgggcggtgacgccgctggggccgcctgccgccgagtactggaacagccagaaggaagtcctggagaggacccgggcggagttggacacggtgtgcagacacaactaccagttggagctccgcacgaccttgcagcggcgag

SEQ ID NO: 2464 - DNA, 248 bp, Homo sapiens
ggccatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgag

SEQ ID NO: 2465 - DNA, 248 bp, Homo sapiens
ggccatgtgctacttcaccaacgggacggagcgcgtgcgttatgtgaccagatacatctataaccgagaggagtacgcacgcttcgacagcgacgtggaggtgtaccgggcggtgacgccgctggggccgcctgacgccgagtactggaacagccagaaggaagacctggagaggacccgggcggagttggacacggtgtgcagacacaactaccagttggagctccgcacgaccttgcagcggcgag

SEQ ID NO: 2466 - DNA, 529 bp, Homo sapiens
gggcatgtgctacttcaccaacgggaccgagctcgtgcggggtgtgaccagatacatctataaccgagaggagtacgcgcgcttcgacagcgacgtgggggtgtatcgggcggtgacgccgctggggcggcttgacgccgagtactggaatagccagaaggacatcctggaggaggaccgggcgtcggtggacaccgtatgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtgg

SEQ ID NO: 2467 - DNA, 529 bp, Homo sapiens
gggcatgtgctacttcaccaacgggaccgagcgcgtgcggggtgtgaccagatacatctataaccgagaggagtacgcgcgcttcgacagcgacgtgggggtgtatcgggcggtgacgccgctggggcggcttgacgccgagtactggaatagccagaaggacatcctggaggaggaccgggcgtcggtggacaccgtatgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtgg

SEQ ID NO: 2468 - DNA, 529 bp, Homo sapiens
ggccatgtgctacttcaccaatgggacggagcgcgtgcgttatgtgaccagatacatctataaccgagaggaggacgtgcgcttcgacagcgacgtgggggtgtatcgggcggtgacgccgcaggggcggcctgacgccgagtactggaacagccagaaggacatcctggagaggacccgagcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgaccaggaggagacagctggcgttgtgtccaccccccttattaggaacggtgactggaccttccagatcctggtgatgctggaaatgactccccagcatggagacgtctacacctgccacgtggagcaccccagcctccagagccccatcaccgtggagtgg

SEQ ID NO: 2469 - DNA, 204 bp, Homo sapiens
gccatgtgctacttcaccaacgggacggagcgcgtgcgttatgtgaccagatacatctataaccgagaggaggacgtgcgcttcgacagcgacgtgggggtgtatcgggcggtgaccccgcaggggcggcctgacgccgagtactggaacagccagaaggacatcctggagaggacccgagcggagttggacacggtgtgcaga

SEQ ID NO: 2470 - DNA, 529 bp, Homo sapiens
ggccatgtgctacttcaccaatgggacggagcgcgtgcgttatgtgaccagatacatctataaccgagaggaggacgtgcgcttcgacagcgacgtgggggtgtatcgggcggtgacgccgcaggggcggcctgacgccgagtactggaacagccagaaggacatcctggagaggacccgagcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgaccaggaagagacagctggcgttgtgtccaccccccttattaggaacggtgactggaccttccagatcctggtgatgctggaaatgactccccagcatggagacgtctacacctgccacgtggagcaccccagcctccagagccccatcaccgtggagtgg

SEQ ID NO: 2471 - DNA, 529 bp, Homo sapiens
gggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtgg

SEQ ID NO: 2472 - DNA, 529 bp, Homo sapiens
gggcatgtgctacttcaccaacgggacggagcgcgtgcgtcttgtaaccagacacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtgg

SEQ ID NO: 2473 - DNA, 529 bp, Homo sapiens
gggcatgtgctacttcaccaacgggacggagcgcgtgcgtcttgtaaccagacacatctataaccgagaggagtacgcgcgcttcgacagcgacgtgggggtgtaccgggcggtgacgccgcaggggcggcctgttgccgagtactggaacagccagaaggaagtcctggagaggacccgggcggagttggacacggtgtgcagacacaactacgaggtggggtaccgcgggatcctgcagaggagagtggagcccacagtgaccatctccccatccaggacagaggccctcaaccaccacaacctgctggtctgctcggtgacagatttctatccaggccagatcaaagtccagtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtgg

SEQ ID NO: 2474 - DNA, 289 bp, Homo sapiens
gggcatgtgctacttcaccaacgggacggagcgcgtgcgtcttgtaaccagacacatctataaccgagaggagtacgcgcgcttcgacagcgacgtgggggtgtaccgcgcggtgacgccgcaggggcggcctgttgccgagtactggaacagccagaaggaagtcctggagaggacccgggcggagttggacacggtgtgcagacacaactacgaggtggggtaccgcgggatcctgcagaggagagtggagcccacagtgaccatctccccatccaggacagaggcc

SEQ ID NO: 2475 - DNA, 289 bp, Homo sapiens
gggcctgtgctacttcaccaacgggacggagcgcgtgcgtcttgtaaccagatacatctataaccgagaggagtacgcgcgcttcgacagcgacgtgggggtgtaccgggcggtgacgccgcaggggcggcctgttgccgagtactggaacagccagaaggaagtcctggagaggacccgggcggagttggacacggtgtgcagacacaactacgaggtggggtaccgcgggatcctgcagaggagagtggagcccacagtgaccatctccccatccaggacagaggcc

SEQ ID NO: 2476 - DNA, 173 bp, Homo sapiens
ggacggagcgcgtgcgtcttgtaaccagatacatctataaccgagaggagtacgcgcgcttcgacagcgacgtgggggtgtaccgggcggtgacgccgcaggggcggcctgtcgccgagtactggaacagccagaaggaagtcctggagaggacccgggcggagttggacacg

SEQ ID NO: 2477 - DNA, 176 bp, Homo sapiens
ggacggagcgcgtgcgtcttgtaaccagatacatctataaccgagaggagtacgcgcgcttcgacagcgacgtgggggtgtaccgggcggtgacgccgcaggggcggcctgttgccgagtactggaacagccagaaggaagtcctggagaggacccgggcggcggtggacagggtg

SEQ ID NO: 2478 - DNA, 236 bp, Homo sapiens
gggcatgtgctacttcaccaacgggacggagcgcgtgcgtcttgtaaccagacacatctataaccgagaggagtacgcgcgcttcgacagcgacgtgggggtgtaccgcgcggtgacgccgcaggggcggcctgatgccgagtactggaacagccagaaggaagtcctggagaggacccgggcggagttggacacggtgtgcagacacaactacgaggtggggtaccgcgggatcc

SEQ ID NO: 2479 - DNA, 236 bp, Homo sapiens
gggcatgtgctacttcaccaacgggacggagcgcgtgcgtcttgtaaccagacacatctataaccgagaggagtacgcgcgcttcgacagcgacgtgggggtgtaccgcgcggtgacgccgcaggggcggcctgttgccgagtactggaacagccagaaggaagtcctggaggggacccgggcggagttggacacggtgtgcagacacaactacgaggtggcgttccgcgggatct

SEQ ID NO: 2480 - DNA, 529 bp, Homo sapiens
gggcatgtgctacttcaccaacgggacggagcgcgtgcgtcttgtaaccagatacatctataaccgagaggagtacgcgcgcttcgacagcgacgtgggggtgtaccgggcggtgacgccgcaggggcggcctgttgccgagtactggaacagccagaaggaagtcctggagaggacccgggcggagttggacacggtgtgcagacacaactacgaggtggggtaccgcgggatcctgcagaggagagtggagcccacagtgaccatctccccatccaggacagaggccctcaaccaccacaacctgctggtctgctcggtgacagatttctatccaggccagatcaaagtccagtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtgg

SEQ ID NO: 2481 - DNA, 248 bp, Homo sapiens
gggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctagcgccgagtactggaacagccagaaggaagtcctggaggggacccgggcggagttggacacggtgtgcagacacaactacgaggtggcgttccgcgggatcttgcagaggagag

SEQ ID NO: 2482 - DNA, 244 bp, Homo sapiens
gggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagagg

SEQ ID NO: 2483 - DNA, 248 bp, Homo sapiens
gggcatgtgctacttcaccaacgggacggagcgcgtgcgtcttgtaaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagag

SEQ ID NO: 2484 - DNA, 529 bp, Homo sapiens
gggcatgtgctacttcaccaacgggacggagcgcgtgcgtcttgtaaccagatacatctataaccgagaggagtacgcgcgcttcgacagcgacgtgggggtgtaccgggcggtgacgccgcaggggcggcctgttgccgagtactggaacagccagaaggaagtcctggaggggacccgggcggagttggacacggtgtgcagacacaactacgaggtggggtaccgcgggatcctgcagaggagagtggagcccacagtgaccatctccccatccaggacagaggccctcaaccaccacaacctgctggtctgctcggtgacagatttctatccaggccagatcaaagtccagtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtgg

SEQ ID NO: 2485 - DNA, 234 bp, Homo sapiens
gggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgttgccgagtactggaacagccagaaggaagtcctggaggggacccgggcggagttggacacggtgtgcagacacaactacgaggtggcgttccgcgggat

SEQ ID NO: 2486 - DNA, 248 bp, Homo sapiens
gggcatgtgctacttcaccaacgggacggagcgcgtgcgtcttgtaaccagacacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagag

SEQ ID NO: 2487 - DNA, 248 bp, Homo sapiens
gggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggagaggacccgggcggagttggacacggtgtgcagacacaactacgaggtggggtaccgcgggatcctgcagaggagag

SEQ ID NO: 2488 - DNA, 248 bp, Homo sapiens
gggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagaactggaacagccagaaggaagtcctggaggggacccgggcggagttggacacggtgtgcagacacaactacgaggtggcgttccgcgggatcttgcagaggagag

SEQ ID NO: 2489 - DNA, 229 bp, Homo sapiens
gggcatgtgctacttcaccaacgggacggagcgcgtgcgtcttgtaaccagacacatctataaccgagaggagtacgcgcgcttcgacagcgacgtgggggtgtaccgggcggtgacgccgcaggggcggcctgttgccgagtactggaacagccagaaggaagtcctggagggggcccgggcggagttggacacggtgtgcagacacaactacgaggtggggtaccgc

SEQ ID NO: 2490 - DNA, 246 bp, Homo sapiens
gggcatgtgctacttcaccaacgggacggagcgcgtgcgtcttgtaaccagatacatctataaccgagaggagtacgcgcgcttcgacagcgacgtgggggtgtaccgggcggtgacgccgcaggggcggcctgttgccgagtactggaacagccagaaggaagtcctggagaggacccgggcggagttggacacggtgtgcagacacaactacgaggtggcgttccgcgggatcttgcagaggag

SEQ ID NO: 2491 - DNA, 248 bp, Homo sapiens
gggcatgtgctacttcaccaacgggacggagcgcgtgcgtcttgtgaccagatacatctataaccgagaggagtacgcgcgcttcgacagcgacgtgggggtgtatcgggcggtgacgccgctggggcggcctgatgccgagtactggaacagccagaaggaagtcctggaggggacccgggcggagttggacacggtgtgcagacacaactacgaggtggcgttccgcgggatcttgcagaggagag

SEQ ID NO: 2492 - DNA, 229 bp, Homo sapiens
gggcctgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgc

SEQ ID NO: 2493 - DNA, 370 bp, Homo sapiens
atggtgtgtctgaagctccctggaggctcctgcatgacagcgctgacagtgacactgatggtgctgagctccccactggctttggctggggacacccgaccacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgag

SEQ ID NO: 2494 - DNA, 270 bp, Homo sapiens
cacgtttcttgtggcagcttaagtttgaatgtcatttcttcaatgggacggagcgggtgcggttgctggaaagatgcatctataaccaagaggaatccgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgag

SEQ ID NO: 2495 - DNA, 283 bp, Homo sapiens
ggggacacccgaccacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcagaggcgggccgcggtggacacctattgcagacacaactacggggctgtggagagcttcacagtgcagcggcgag

SEQ ID NO: 2496 - DNA, 246 bp, Homo sapiens
cacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcagaggcgggccgccgtggacacctattgcagacacaactacggggctgtgg

SEQ ID NO: 2497 - DNA, 370 bp, Homo sapiens
atggtgtgtctgaagctccctggaggctcctgcatgacagcgctgacagtgacactgatggtgctgagctccccactggctttggctggggacacccgaccacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacatcctggaagacgagcgggccgcggtggacacctactgcagacacaactacggggttggtgagagcttcacagtgcagcggcgag

SEQ ID NO: 2498 - DNA, 283 bp, Homo sapiens
ggggacacccgaccacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcagaggcgggccgcggtggacaattactgcagacacaactacggggttgtggagagcttcacagtgcagcggcgag

SEQ ID NO: 2499 - DNA, 270 bp, Homo sapiens
cacgtttcttgtggcagcttaagtttgaatgtcatttcttcaatgggacggagcgggtgcggttgctggaaagatgcatctataaccaagaggagtccgtgcgcttcgacagcgacgtgagggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgag

SEQ ID NO: 2500 - DNA, 270 bp, Homo sapiens
cacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcaggcgcgggccgcggtggacacctactgcagacacaactacggggttgtggagagcttcacagtgcagcggcgag

SEQ ID NO: 2501 - DNA, 270 bp, Homo sapiens
cacgtttcttgtgggagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgag

SEQ ID NO: 2502 - DNA, 270 bp, Homo sapiens
cacgtttcttgtggcagcttaagtttgaatgtcatttcttcaatgggacggagcgggtgcggttgctggaaagatgcatctataaccaagaggagtacgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgag

SEQ ID NO: 2503 - DNA, 270 bp, Homo sapiens
cacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcaggcgcgggccgcggtggacacctactgcagacacaactacggggttggtgagagcttcacagtgcagcggcgag

SEQ ID NO: 2504 - DNA, 270 bp, Homo sapiens
cacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcagaagcgggccgcggtggacacctactgcagacacaactacggggttggtgagagcttcacagtgcagcggcgag

SEQ ID NO: 2505 - DNA, 283 bp, Homo sapiens
ggggacaccagaccacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgag

SEQ ID NO: 2506 - DNA, 265 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaattactgcagacacaactacggggttgtggagagcttcacagtgcagcg

SEQ ID NO: 2507 - DNA, 283 bp, Homo sapiens
ggggacaccagaccacgtttcttggagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacctcctggagcagaagcggggccgggtggacaactactgcagacacaactacggggttggtgagagcttcacagtgcagcggcgag

SEQ ID NO: 2508 - DNA, 283 bp, Homo sapiens
ggggacaccagaccacgtttcttggagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacctcctggagcagaagcggggccgggtggacaattactgcagacacaactacggggttggtgagagcttcacagtgcagcggcgag

SEQ ID NO: 2509 - DNA, 255 bp, Homo sapiens
tactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacctcctggagcagaagcggggccgggtggacaactactgcagacacaactacggggttgtggagagcttcacagtgcagcggcga

SEQ ID NO: 2510 - DNA, 270 bp, Homo sapiens
cacgtttcttggagtactctacgtctgagtgtcatttcttcaatgggacggagcgggtgcggtacctggacagatacttccataaccaggaggagtccgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgag

SEQ ID NO: 2511 - DNA, 270 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttggtgagagcttcacagtgcagcggcgag

SEQ ID NO: 2512 - DNA, 270 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttggtgagagcttcacggtgcagcggcgag

SEQ ID NO: 2513 - DNA, 258 bp, Homo sapiens
ttcttggagtactctacgtctgagtgtcatttcttcaatgggacggagcgggtgcggtacctggacagatacttccataaccaggaggagaacgtgcgcttcgacagcgacgtgggggagtaccgggcggtgacggagctggggcggcctgatgccgagtactggaacagccagaaggacctcctggagcagaagcggggccgggtggacaactactgcagacacaactacggggttgtggagagcttcacagtgcag

SEQ ID NO: 2514 - DNA, 283 bp, Homo sapiens
ggggacaccagaccacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgag

SEQ ID NO: 2515 - DNA, 283 bp, Homo sapiens
ggggacaccagaccacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgaggagtactggaacagccagaaggacctcctggagcagaagcggggccgggtggacaactactgcagacacaactacggggttgtggagagcttcacagtgcagcggcgag

SEQ ID NO: 2516 - DNA, 258 bp, Homo sapiens
ttggagtactctacgtctgagtgtcatttcttcaatgggacggagcgggtgcggtacctggacagatacttccataaccgggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttggtgagagcttcacagtgcagcgg

SEQ ID NO: 2517 - DNA, 283 bp, Homo sapiens
ggggacaccagaccacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgctgcggagcactggaacagccagaaggacctcctggagcagaagcggggccgggtggacaactactgcagacacaactacggggttgtggagagcttcacagtgcagcggcgag

SEQ ID NO: 2518 - DNA, 269 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccaggtggacaactactgcagacacaactacggggttgtggagagcttcacagtgcagcggcga

SEQ ID NO: 2519 - DNA, 240 bp, Homo sapiens
ttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctagcgccgagtactggaacagccagaaggacctcctggagcagaagcggggccgggtggacaactactgcagacacaactacggggttgtggag

SEQ ID NO: 2520 - DNA, 270 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtcctggaacagccagaaggacctcctggagcagaagcggggccgggtggacaactactgcagacacaactacggggttgtggagagcttcacagtgcagcggcgag

SEQ ID NO: 2521 - DNA, 270 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacacctactgcagacacaactacggggttggtgagagcttcacagtgcagcggcgag

SEQ ID NO: 2522 - DNA, 269 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacacctactgcagacacaactacggggttgtggagagcttcacagtgcagcggcga

SEQ ID NO: 2523 - DNA, 245 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttctgggcggtgacggagctggggcggcctgatgccgagtactggaacagccagaaggacctcctggagcagaagcggggccgggtggacaactactgcagacacaactacggggttgtg

SEQ ID NO: 2524 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgagagcttcacagtgcagcggcgag

SEQ ID NO: 2525 - DNA, 270 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgcgggagttccgggcggtgacggagctggggcggcctgatgccgagtactggaacagccagaaggacctcctggagcagaagcggggccgggtggacaactactgcagacacaactacggggttgtggagagcttcacagtgcagcggcgag

SEQ ID NO: 2526 - DNA, 270 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacatcctggagcagaagcggggccgggtggacaactactgcagacacaactacggggttgtggagagcttcacagtgcagcggcgag

SEQ ID NO: 2527 - DNA, 266 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggctgtggagagcttcacagtgcagcgg

SEQ ID NO: 2528 - DNA, 267 bp, Homo sapiens
cgtttcttggagtactctacgtctgagtgtcatttcttcaatgggacggagcgggtgcggttcctggacagatacttccataaccaggaggagttcgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcga

SEQ ID NO: 2529 - DNA, 266 bp, Homo sapiens
tttcttggagtactctacgtctgagtgtcatttcttcaatgggacggagcgggtgcggtacctggacagatacttcgataaccaggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgag

SEQ ID NO: 2530 - DNA, 270 bp, Homo sapiens
cacgtttcttggagtactctacgtctgagtgtcatttcttcaatgggacggagcgggtgcggtacctggacagatacttccataaccgggaggagaacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgag

SEQ ID NO: 2531 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacctcctggagcagaagcggggccaggtggacaattactgcagacacaactacggggttgtggagagcttcacagtgcagcggcgag

SEQ ID NO: 2532 - DNA, 270 bp, Homo sapiens
cacgtttcttggagtactctacgtctgagtgtcatttcttcaatgggacggagcgggtgcggtacctggacagatacttccataaccaggaggagtacgtgcgcttcgacagcgacgtgggggagttccgggcggtgacggagctggggcggcctgatgccgagtactggaacagccagaaggacctcctggagcagaagcggggccgggtggacaactactgcagacacaactacggggttgtggagagcttcacagtgcagcggcgag

SEQ ID NO: 2533 - DNA, 370 bp, Homo sapiens
atggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaagcgggccgcggtggacacctactgcagacacaactacggggttggtgagagcttcacagtgcagcggcgag

SEQ ID NO: 2534 - DNA, 270 bp, Homo sapiens
cacgtttcttggagcaggttaaacatgagtgtcatttcttcaacgggacggagcgggtgcggttcctggacagatacttctatcaccaagaagagtacgtgcgcttcgacagcgacgtgggggagtaccgggcggtgacggagctggggcggcctgatgccgagtactggaacagccagaaggacctcctggagcagaagcgggccgcggtggacacctactgcagacacaactacggggttggtgagagcttcacagtgcagcggcgag

SEQ ID NO: 2535 - DNA, 370 bp, Homo sapiens
atggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacatcctggaagacgagcgggccgcggtggacacctactgcagacacaactacggggttgtggagagcttcacagtgcagcggcgag

SEQ ID NO: 2536 - DNA, 283 bp, Homo sapiens
ggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgag

SEQ ID NO: 2537 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgacgctgagtactggaacagccagaaggacctcctggagcagaggcgggccgaggtggacacctactgcagacacaactacggggttgtggagagcttcacagtgcagcggcgag

SEQ ID NO: 2538 - DNA, 370 bp, Homo sapiens
atggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttgtggagagcttcacagtgcagcggcgag

SEQ ID NO: 2539 - DNA, 282 bp, Homo sapiens
ggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctagcgccgagtactggaacagccagaaggacctcctggagcagaggcgggccgcggtggacacctactgcagacacaactacggggttggtgagagcttcacagtgcagcggcga

SEQ ID NO: 2540 - DNA, 270 bp, Homo sapiens
cacgtttcttggagcaggttaaacatgagtgtcatttcttcaacgggacggagcgggtgcggttcctggacagatacttctatcaccaagaggagtacgtgcggttcgacagcgacgtgggggagtaccgggcggtgacggagctggggcggcctagcgccgagtactggaacagccagaaggacctcctggagcagaggcgggccgcggtggacacctactgcagacacaactacggggttggtgagagcttcacagtgcagcggcgag

SEQ ID NO: 2541 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctagcgccgagtactggaacagccagaaggacctcctggagcagaggcgggccgcggtggacacctactgcagacacaactacggggttggtgagagcttcacagtgcagcgacgag

SEQ ID NO: 2542 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctagcgccgagtactggaacagccagaaggacctcctggagcagaggcgggccgcggtggacacctactgcagacacaactacggggttggtgagagcttcacggtgcagcggcgag

SEQ ID NO: 2543 - DNA, 283 bp, Homo sapiens
ggggacacccgaccacgtttcttggagcaggttaaacatgagtgtcatttcttcaacgggacggagcgggtgcggttcctggacagatacttctatcaccaagaggagtccgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcggcgag

SEQ ID NO: 2544 - DNA, 282 bp, Homo sapiens
ggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttggtgagagcttcacagtgcagcggcga

SEQ ID NO: 2545 - DNA, 266 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagagacgggccgaggtggacacctactgcagacacaactacggggttggtgagagcttcacagtgcagcgg

SEQ ID NO: 2546 - DNA, 266 bp, Homo sapiens
tttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgag

SEQ ID NO: 2547 - DNA, 225 bp, Homo sapiens
tgagtgtcatttcttcaacgggacggagcgggtgcggttcctggacagatacttctatcaccaagaggagtacgtgcgcttcgacagcgacgtgggggagtaccgggcggtgacggagctggggcggcctagcgccgagtactggaacagccagaaggacctcctggagcagaagcgggccgcggtggacacctactgcagacacaactacggggttggtgagag

SEQ ID NO: 2548 - DNA, 266 bp, Homo sapiens
tttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctagcgccgagtactggaacagccagaaggacctcctggagcagaggcgggccgcggtggacacctactgcagacacaactacggggttgtggagagcttcacagtgcagcggcgag

SEQ ID NO: 2549 - DNA, 370 bp, Homo sapiens
atggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctagcgccgagtactggaacagccagaaggacctcctggagcagaggcgggccgaggtggacacctactgcagacacaactacggggttgtggagagcttcacagtgcagcggcgag

SEQ ID NO: 2550 - DNA, 261 bp, Homo sapiens
ttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctagcgccgagtactggaacagccagaaggacatcctggaagacaggcgggccctggtggacacctactgcagacacaactacggggttgtggagagcttcacagtgcagcgg

SEQ ID NO: 2551 - DNA, 234 bp, Homo sapiens
catgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaagcgggccgcggtggacacctactgcagacacaactacggggttgtggagagcttcaca

SEQ ID NO: 2552 - DNA, 225 bp, Homo sapiens
tgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacatcctggaagacgagcgggccgcggtggacacctactgcagacacaactacggggttggtgagag

SEQ ID NO: 2553 - DNA, 250 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgaggagtactggaacagccagaaggacttcctggaagacaggcgggccgcggtggacacctactgcagacacaactacggggttgtggagag

SEQ ID NO: 2554 - DNA, 222 bp, Homo sapiens
atgagtgtcatttcttcaacgggacggagcgggtgcggttcctggacagatacttctatcaccaagaggagtacgtgcgcttcgacagcgacgtgggggagtaccgggcggtgacggagctggggcggcctgatgcccagtactggaacagccagaaggacctcctggagcagaagcgggccgcggtggacacctactgcagacacaactacggggttggtg

SEQ ID NO: 2555 - DNA, 221 bp, Homo sapiens
atgagtgtcatttcttcaacgggacggagcgggtgcggttcctggacagatacttctatcaccaagaggagtacgtgcgcttcgacagcgacgtgggggagtaccgggcggtgacggagctggggcggcctagcgccgagtactggaacagccagaaggacctcctggagcagaggcgggccgaggtggacacctactgcagacacaactacggggttggt

SEQ ID NO: 2556 - DNA, 238 bp, Homo sapiens
atgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacatcctggaagacaggcgggccctggtggacacctactgcagacacaactacggggttgtggagagcttcacagtgca

SEQ ID NO: 2557 - DNA, 266 bp, Homo sapiens
tttcttggagcaggttaaacatgagtgtcatttcttcaacgggacggagcgggtgcggttcctggacagatacttctatcaccaagaggagtccgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgag

SEQ ID NO: 2558 - DNA, 222 bp, Homo sapiens
atgagtgtcatttcttcaacgggacggagcgggtgcggttcctggacagatacttctatcaccaagaggagtccgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttggtg

SEQ ID NO: 2559 - DNA, 249 bp, Homo sapiens
gagcaggttaaacatgagtgtcatttcttcaacgggacggagcgggtgcggttcctggacagatacttctatcaccaagaggagtccgtgcgcttcgacagcgacgtgggggagtaccgggcggtgacggagctggggcggcctgatgccgagtactggaacagccagaaggacctcctggagcagaagcgggccgcggtggacacctactgcagacacaactacggggttggtgagagcttcacagtg

SEQ ID NO: 2560 - DNA, 246 bp, Homo sapiens
gagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaagcggggccgggtggacaactactgcagacacaactacggggttgtggagagcttcaca

SEQ ID NO: 2561 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttgtggagagattcacagtgcagcggcgag

SEQ ID NO: 2562 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctagcgccgagtactggaacagccagaaggacctcctggagcggaggcgggccgcggtggacacctactgcagacacaactacggggttggtgagagcttcacagtgcagcggcgag

SEQ ID NO: 2563 - DNA, 242 bp, Homo sapiens
ttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacttcctggaagacaggcgggccctggtggacacctactgcagacacaactacggggttgtggagag

SEQ ID NO: 2564 - DNA, 246 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgataccgagtactggaacagccagaaggacctcctggagcagaagcgggccgcggtggacacctactgcagacacaactacggggttggtg

SEQ ID NO: 2565 - DNA, 260 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggctgtggagagcttcacagtg

SEQ ID NO: 2566 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagttccgggcggtgacggagctggggcggcctagcgccgagtactggaacagccagaaggacctcctggagcagaggcgggccgcggtggacacctactgcagacacaactacggggttggtgagagcttcacagtgcagcggcgag

SEQ ID NO: 2567 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgatggagctggggcggcctagcgccgagtactggaacagccagaaggacctcctggagcagaggcgggccgcggtggacacctactgcagacacaactacggggttggtgagagcttcacagtgcagcggcgag

SEQ ID NO: 2568 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggtggtgacggagctggggcggcctagcgccgagtactggaacagccagaaggacctcctggagcagaggcgggccgcggtggacacctactgcagacacaactacggggttggtgagagcttcacagtgcagcggcgag

SEQ ID NO: 2569 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccctggtggacacctactgcagacacaactacggggttggtgagagcttcacagtgcagcggcgag

SEQ ID NO: 2570 - DNA, 240 bp, Homo sapiens
ttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcaggccgcggtggacacctactgcagacacaactacggggttgtggag

SEQ ID NO: 2571 - DNA, 270 bp, Homo sapiens
cacgtttcttggagcaggttaaacatgagtgtcatttcttcaacgggacggagcgggtgcggttcctggacagatacttctatcaccaagaggagtacgtgcacttcgacagcgacgtgggggagtaccgggcggtgacggagctggggcggcctgatgccgagtactggaacagccagaaggacctcctggagcagaagcgggccgcggtggacacctactgcagacacaactacggggttggtgagagcttcacagtgcagcggcgag

SEQ ID NO: 2572 - DNA, 243 bp, Homo sapiens
tttcttggagcaggttaaacctgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaagcgggccgcggtggacacctactgcagacacaactacggggttggtga

SEQ ID NO: 2573 - DNA, 260 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagttccgggcggtgacggagctggggcggcctgatgccgagtactggaacagccagaaggacctcctggagcagaagcgggccgcggtggacacctactgcagacacaactacggggttggtgagagcttcacagtg

SEQ ID NO: 2574 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacttcctggaagacaggcgggccgcggtggacacctactgcagacacaactacggggttgtggagagcttcacagtgcagcggcgag

SEQ ID NO: 2575 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggaagacgagcgggccgcggtggacacctactgcagacacaactacggggttgtggagagcttcacagtgcagcggcgag

SEQ ID NO: 2576 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacatcctggagcagaagcgggccgcggtggacacctactgcagacacaactacggggttggtgagagcttcacagtgcagcggcgag

SEQ ID NO: 2577 - DNA, 266 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggactaccgggcggtgacggagctggggcggcctgatgccgagtactggaacagccagaaggacctcctggagcagaggcgggccgaggtggacacctactgcagacacaactacggggttgtggagagcttcacagtgcagcgg

SEQ ID NO: 2578 - DNA, 266 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatggcgagtactggaacagccagaaggacctcctggagcagaggcgggccgcggtggacacctactgcagacacaactacggggttgtggagagcttcacagtgcagcgg

SEQ ID NO: 2579 - DNA, 266 bp, Homo sapiens
cacgtttcttggagcaggttaaacatgagtgtcatttcttcaacgggacggagcgggtgcggttcctggacagatacttctatcaccaagaggagaacgtgcgcttcgacagcgacgtgggggagtaccgggcggtgacggagctggggcggcctgatgccgagtactggaacagccagaaggacctcctggagcagaggcgggccgaggtggacacctactgcagacacaactacggggttgtggagagcttcacagtgcagcgg

SEQ ID NO: 2580 - DNA, 270 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagttccgggcggtgacggagctggggcggcctgatgccgagtactggaacagccagaaggacctcctggagcagaggcgggccgcggtggacacctactgcagacacaactacggggttgtggagagcttcacagtgcagcggcgag

SEQ ID NO: 2581 - DNA, 266 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagttccgggcggtgacggagctggggcggcctgatgccgagtactggaacagccagaaggacctcctggagcagaggcgggccgcggtggacacctactgcagacacaactacggggttggtgagagcttcacagtgcagcgg

SEQ ID NO: 2582 - DNA, 264 bp, Homo sapiens
cacgtttcttggagcaggttaaacatgagtgtcatttcttcaacgggacggagcgggtgcggttcctggacagatacttctatcaccaagaggagtacgtgcgcttcgacagcgacgtgggggagtaccgggcggtgacggagctggggcggcctgatgccgagtactggaacagccagaaggacctcctggagcagaggcgggccgcggtggacaattactgcagacacaactacggggttgtggagagcttcacagtgcagc

SEQ ID NO: 2583 - DNA, 370 bp, Homo sapiens
atggtgtgtctgaagctccctggaggctcctgcatggcagctctgacagtgacactgatggtgctgagctccccactggctttggctggggacacccaaccacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtgagagcttcacagtgcagcggcgag

SEQ ID NO: 2584 - DNA, 246 bp, Homo sapiens
cacgtttcctgtggcagggtaaatataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtg

SEQ ID NO: 2585 - DNA, 246 bp, Homo sapiens
cacgtttcctgtggcagggtaagtataagtgtcatttcttcaacgggacggagcgggtgcagttcctggaaagtctcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaccgtgtgcagacacaactacggggttggtg

SEQ ID NO: 2586 - DNA, 247 bp, Homo sapiens
tttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccagaaggacatcctggaggacaggcggggccaggtggacaattactgcagacacaactacggggttggtgagagc

SEQ ID NO: 2587 - DNA, 258 bp, Homo sapiens
cacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgtcgccgagtcctggaacagccggaaggacatcctggaggacaggcggggccaggtggacaccgtgtgcagacacaactacggggttggtgagagcttcacag

SEQ ID NO: 2588 - DNA, 250 bp, Homo sapiens
cacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggcggcctgctgcggagtactggaacagccagaaggacatcctggaggacaggcggggccaggtggacaccgtgtgcagacacaactacggggttggtgagag

SEQ ID NO: 2589 - DNA, 260 bp, Homo sapiens
cacgtttcctgtggcagggtaagtataagtgtcatttcttcaacgggacggagcgggtgcagttcctggaaagactcttctataaccaggaggagttcgtgcgcttcgacagcgacgtgggggagtaccgggcggtgacggagctagggtggcctgtcgccgagtcctggaacagccagaaggacatcctggaggacaggcggggccaggtggacaccgtgtgcagacacaactacggggttggtgagagcttcacagtg

SEQ ID NO: 2590 - DNA, 283 bp, Homo sapiens
ggggacacccgaccacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacttcctggaagacaggcgggccctggtggacacctactgcagacacaactacggggttggtgagagcttcacggtgcagcggcgag

SEQ ID NO: 2591 - DNA, 270 bp, Homo sapiens
cacgtttcttggagtactctacgggtgagtgttatttcttcaatgggacggagcgggtgcggttcctggacagatatttctataaccaagaggagtacgtgcgcttcgacagcgacgtgggggagtaccgggcggtgacggagctggggcggcctagcgccgagtactggaacagccagaaggacttcctggaagacaggcgggccctggtggacacctactgcagacacaactacggggttggtgagagcttcacggtgcagcggcgag

SEQ ID NO: 2592 - DNA, 370 bp, Homo sapiens
atggtgtgtctgaggctccctggaggctcctgcatggcagttctgacagtgacactgatggtgctgagctccccactggctttggctggggacaccagaccacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacttcctggaagacaggcgggccctggtggacacctactgcagacacaactacggggttggtgagagcttcacggtgcagcggcgag

SEQ ID NO: 2593 - DNA, 270 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacttcctggaagacaggcgggccctggtggacacctactgcagacacaactacggggttggtgagagcttcacagtgcagcggcgag

SEQ ID NO: 2594 - DNA, 258 bp, Homo sapiens
cgtttcttggagtactctacgggtgagtgttatttcttcaatgggacggagcgggtgcggttcctggacagatacttctataaccaagaggagtacgtgcgcttcgacagcgacgtgggggagtaccgggcggtgacagagctggggcggcctgatgccgagtactggaacagccagaaggacttcctggaagacaggcgggccctggtggacacctactgcagacacaactacggggttggtgagagcttcacggtg

SEQ ID NO: 2595 - DNA, 283 bp, Homo sapiens
ggggacaccagaccacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacaggcgggccctggtggacacctactgcagacacaactacggggttggtgagagcttcacagtgcagcggcgag

SEQ ID NO: 2596 - DNA, 283 bp, Homo sapiens
ggggacaccagaccacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacttcctggaagacaggcgggccctggtggacacctactgcagacacaactacggggttgtggagagcttcacagtgcagcggcgag

SEQ ID NO: 2597 - DNA, 228 bp, Homo sapiens
ttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacttcctggaagacaggcgggccctggtggacacctactgcagacacaactacggggttgttgagagcttcacagtgcagcgg

SEQ ID NO: 2598 - DNA, 269 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacttcctggaagacaggcgggccctggtggacacctactgcagacacaactacggggttgttgagagcttcacggtgcagcggcga

SEQ ID NO: 2599 - DNA, 270 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacttcctggaagacaggcgggccctggtggacacctactgcagacacaactacggggttgtggagagcttcacggtgcagcggcgag

SEQ ID NO: 2600 - DNA, 245 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacttcctggaagacaggcgggccgcggtggacacctactgcagacacaactacggggttggt

SEQ ID NO: 2601 - DNA, 271 bp, Homo sapiens
ccacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacttcctggaagacaggcgggccctggtggacacctactgcagacacaactacggggttgtggagagcttcacagtgcagcggcgag

SEQ ID NO: 2602 - DNA, 270 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctgttgccgagtactggaacagccagaaggacttcctggaagacaggcgggccctggtggacacctactgcagacacaactacggggttggtgagagcttcacggtgcagcggcgag

SEQ ID NO: 2603 - DNA, 240 bp, Homo sapiens
ttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctgctgcggagcactggaacagccagaaggacttcctggaagacaggcgggccctggtggacacctactgcagacacaactacggggttggtgag

SEQ ID NO: 2604 - DNA, 270 bp, Homo sapiens
cacgtttcttggagtactctacgggtgagtgttatttcttcaatgggacggagcgggtgcggttcctggacagatacttccataaccaggaggagttcgtgcgcttcgacagcgacgtgggggagtaccgggcggtgacggagctggggcggcctgatgccgagtactggaacagccagaaggacttcctggaagacaggcgggccctggtggacacctactgcagacacaactacggggttggtgagagcttcacggtgcagcggcgag

SEQ ID NO: 2605 - DNA, 270 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacaggcgggccctggtggacacctactgcagacacaactacggggttgtggagagcttcacagtgcagcggcgag

SEQ ID NO: 2606 - DNA, 260 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctgctgccgagtactggaacagccagaaggacttcctggaagacaggcgggccctggtggacacctactgcagacacaactacggggttggtgagagcttcacggtg

SEQ ID NO: 2607 - DNA, 270 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacaggcgggccctggtggacacctactgcagacacaactacggggctgtggagagcttcacagtgcagcggcgag

SEQ ID NO: 2608 - DNA, 254 bp, Homo sapiens
tcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacctcctggaagacaggcgggccctggtggacacctactgcagacacaactacggggttggtgagagcttcacggtg

SEQ ID NO: 2609 - DNA, 260 bp, Homo sapiens
cacgtttcttggagtactctaggggtgagtgttatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacaggcgggccctggtggacacctactgcagacacaactacggggttggtgagagcttcacagtg

SEQ ID NO: 2610 - DNA, 242 bp, Homo sapiens
tttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctgatgcggagcactggaacagccagaaggacatcctggaagacaggcgggccctggtggacacctactgcagacacaactacggggttggtg

SEQ ID NO: 2611 - DNA, 270 bp, Homo sapiens
cacgtttcttggagtactctacgggtgagtgttatttcttcaatgggacggagcgggtgcggttcctggacagatacttctataaccaagaggaggacgtgcgcttcgacagcgacgtgggggagtaccgggcggtgacggagctggggcggcctagcgccgagtactggaacagccagaaggacttcctggaagacaggcgggccctggtggacacctactgcagacacaactacggggttggtgagagcttcacggtgcagcggcgag

SEQ ID NO: 2612 - DNA, 246 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagttccgggcggtgacggagctggggcggcctagcgccgagtactggaacagccagaaggacttcctggaagacaggcgggccctggtggacacctactgcagacacaactacggggttggtg

SEQ ID NO: 2613 - DNA, 270 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacaggcgggccgcggtggacacctactgcagacacaactacggggttggtgagagcttcacagtgcagcggcgag

SEQ ID NO: 2614 - DNA, 257 bp, Homo sapiens
tttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctatcgccgagtactggaacagccagaaggacatcctggaagacaggcgggccctggtggacacctactgcagacacaactacggggttggtgagagcttcacagtgc

SEQ ID NO: 2615 - DNA, 269 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacttcctggaagacaggcgggccctggtggacacctactgcagacacaactacggggttgtggagagcttcacagtgcagcggcga

SEQ ID NO: 2616 - DNA, 269 bp, Homo sapiens
cacgtttcttggagtactctatgggtgagtgttatttcttcaatgggacggagcgggtgcggttcctggacagatacttccataaccaggaggagttcgtgcgcttcgacagcgacgtgggggagtaccgggcggtgacggagctggggcggcctgatgccgagtactggaacagccagaaggacttcctggaagacaggcgggccctggtggacacctactgcagacacaactacggggttggtgagagcttcacggtgcagcggcga

SEQ ID NO: 2617 - DNA, 270 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacttcctggaagacaggcgggccctggtggacacctactgcagacacaactacggggctgtggagagcttcacggtgcagcggcgag

SEQ ID NO: 2618 - DNA, 270 bp, Homo sapiens
cacgtttcttggagtactctacgggtgagtgttatttcttcaatgggacggagcgggtgcggttcctggacagatacttctataaccaagaggagtacgtgcgcttcgacagcgacgtgagggagtaccgggcggtgacggagctggggcggcctagcgccgagtactggaacagccagaaggacatcctggaagacaggcgggccctggtggacacctactgcagacacaactacggggttggtgagagcttcacagtgcagcggcgag

SEQ ID NO: 2619 - DNA, 266 bp, Homo sapiens
cacgtttcttggagtactctacgggtgagtgttatttcttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacttcctggaagacaggcgggccgcggtggacacctactgcagacacaactacggggttggtgagagcttcacagtgcagcgg

SEQ ID NO: 2620 - DNA, 283 bp, Homo sapiens
ggggacacccaaccacgtttcttgaagcaggataagtttgagtgtcatttcttcaacgggacggagcgggtgcggtatctgcacagaggcatctataaccaagaggagaacgtgcgcttcgacagcgacgtgggggagtaccgggcggtgacggagctggggcggcctgtcgccgagtcctggaacagccagaaggacttcctggagcggaggcgggccgaggtggacaccgtgtgcagacacaactacggggttggtgagagcttcacagtgcagaggcgag

SEQ ID NO: 2621 - DNA, 270 bp, Homo sapiens
cacgtttcttgaagcaggataagtttgagtgtcatttcttcaacgggacggagcgggtgcggtatctgcacagaggcatctataaccaagaggagaacgtgcgcttcgacagcgacgtgggggagtaccgggcggtgacggagctggggcggcctgacgctgagtactggaacagccagaaggacttcctggagcggaggcgggccgaggtggacaccgtgtgcagacacaactacggggttggtgagagcttcacagtgcagaggcgag

SEQ ID NO: 2622 - DNA, 370 bp, Homo sapiens
atggtgtgtctgaggctccctggaggctcctgcatggcagttctgacagtgacactgatggtgctgagctccccactggctttggctggggacaccagaccacgtttcttggaggaggttaagtttgagtgtcatttcttcaacgggacggagcgggtgcggttgctggaaagacgcgtccataaccaagaggagtacgcgcgctacgacagcgacgtgggggagtaccgggcggtgacggagctggggcggcctgatgccgagtactggaacagccagaaggacctcctggagcggaggcgtgccgcggtggacacctactgcagacacaactacggggttggtgagagcttcacagtgcagcggcgag

SEQ ID NO: 2623 - DNA, 270 bp, Homo sapiens
cacgtttcttggaggaggttaagtttgagtgtcatttcttcaacgggacggagcgggtgcggttgctggaaagacgcgtccataaccaagaggagtacgcgcgctacgacagcgacgtgggggagtaccgggcggtgacggagctggggcggcctgatgccgagtactggaacagccagaaggacctcctggagcggaggcgcgccgcggtggacacctactgcagacacaactacggggttggtgagagcttcacagtgcagcggcgag

SEQ ID NO: 2624 - DNA, 370 bp, Homo sapiens
atggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacagtgcagcggcgag

SEQ ID NO: 2625 - DNA, 283 bp, Homo sapiens
ggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacggtgcagcggcgag

SEQ ID NO: 2626 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgcgccgcggtggacacctactgcagacacaactacggggttggtgagagcttcacagtgcagcggcgag

SEQ ID NO: 2627 - DNA, 268 bp, Homo sapiens
cgtttcttggagtactctacgtctgagtgtcatttcttcaacgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacagtgcagcggcgag

SEQ ID NO: 2628 - DNA, 283 bp, Homo sapiens
ggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacatcctggaagacgagcgggccgcggtggacacctactgcagacacaactacggggttgtggagagcttcacagtgcagcggcgag

SEQ ID NO: 2629 - DNA, 370 bp, Homo sapiens
atggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacgagcgggccgcggtggacacctactgcagacacaactacggggttgtggagagcttcacagtgcagcggcgag

SEQ ID NO: 2630 - DNA, 370 bp, Homo sapiens
atggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttgtggagagcttcacagtgcagcggcgag

SEQ ID NO: 2631 - DNA, 283 bp, Homo sapiens
ggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttgtggagagcttcacggtgcagcggcgag

SEQ ID NO: 2632 - DNA, 270 bp, Homo sapiens
ccacgtttcttggagtactctacgggtgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacagtgcagcggcga

SEQ ID NO: 2633 - DNA, 268 bp, Homo sapiens
cgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggctgtggagagcttcacagtgcagcggcgag

SEQ ID NO: 2634 - DNA, 266 bp, Homo sapiens
tttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctattgcagacacaactacggggctgtggagagcttcacagtgcagcggcgag

SEQ ID NO: 2635 - DNA, 262 bp, Homo sapiens
ttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacctcctggagcagaagcggggccgggtggacaactactgcagacacaactacggggttgtggagagcttcacagtgcagcggcgag

SEQ ID NO: 2636 - DNA, 238 bp, Homo sapiens
gtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacctcctggaagacaggcgggccgcggtggacacctactgcagacacaactacggggttggtgagagcttcacagtg

SEQ ID NO: 2637 - DNA, 238 bp, Homo sapiens
gtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacctcctggaagacaggcgggccgcggtggacacctactgcagacacaactacggggttggtgagagcttcacggtg

SEQ ID NO: 2638 - DNA, 231 bp, Homo sapiens
catttcttcaatgggacggagcgggtgcggttcctggacagatacttccataaccaggaggagaacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacagtgcag

SEQ ID NO: 2639 - DNA, 219 bp, Homo sapiens
gagtgtcatttcttcaatgggacggagcgggtgcggttcctggacagatacttccataaccaggaggagttcgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggt

SEQ ID NO: 2640 - DNA, 266 bp, Homo sapiens
tttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacgagcgggccgcggtggacacctactgcagacacaactacggggttggtgagagcttcacagtgcagcggcgag

SEQ ID NO: 2641 - DNA, 219 bp, Homo sapiens
gagtgtcatttcttcaatgggacggagcgggtgcggttcctggacagatacttctataaccaagaggagttcgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggt

SEQ ID NO: 2642 - DNA, 270 bp, Homo sapiens
cacgtttcttggagtactctacgtctgagtgtcatttcttcaatgggacggagcgggtgcggttcctggacagatacttctataaccaggaggagttcgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacagtgcagcggcgag

SEQ ID NO: 2643 - DNA, 282 bp, Homo sapiens
ggggacaccagaccacgtttcttggagtactctacgtctgagtgtcatttcttcaatgggacggagcgggtgcggttcctggacagatacttccataaccaggaggagttcgtgcgcttcgacagcgacgtgggggagttccgggcggtgacggagctggggcggcctgatgaggagtactggaacagccagaaggacctcctggagcggaggcgggccgcggtggacacctattgcagacacaactacggggttgtggagagcttcacagtgcagcggcga

SEQ ID NO: 2644 - DNA, 283 bp, Homo sapiens
ggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacatcctggaagacgagcgggccgcggtggacacctactgcagacacaactacggggttggtgagagcttcacagtgcagcggcgag

SEQ ID NO: 2645 - DNA, 283 bp, Homo sapiens
ggggacaccagaccacgtttcttggagtactctacgtctgagtgtcatttcttcaatgggacggagcgggtgcggttcctggacagatacttctataaccaagaggaggacttgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacagtgcagcggcgag

SEQ ID NO: 2646 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgaggagtactggaacagccagaaggacatcctggaagacgagcgggccgcggtggacacctactgcagacacaactacggggttgtggagagcttcacagtgcagcggcgag

SEQ ID NO: 2647 - DNA, 283 bp, Homo sapiens
ggggacaccagaccacgtttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgatgaggagtactggaacagccagaaggacctcctggagcggaggcgggccgaggtggacacctattgcagacacaactacggggttgtggagagcttcacagtgcagcggcgag

SEQ ID NO: 2648 - DNA, 266 bp, Homo sapiens
tttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacatcctggaagacaggcgggccgcggtggacacctactgcagacacaactacggggttgtggagagcttcacagtgcagcggcgag

SEQ ID NO: 2649 - DNA, 266 bp, Homo sapiens
tttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacatcctggaagacaggcgggccgcggtggacacctactgcagacacaactacggggttggtgagagcttcacagtgcagcggcgag

SEQ ID NO: 2650 - DNA, 256 bp, Homo sapiens
ttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgaggagtactggaacagccagaaggacatcctggaagacgagcgggccgcggtggacacctactgcagacacaactacggggttggtgagagcttcacagtgcagc

SEQ ID NO: 2651 - DNA, 241 bp, Homo sapiens
ttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacatcctggaagacgagcgggccgcggtggacacctactgcagacacaactacggggctgtggaga

SEQ ID NO: 2652 - DNA, 250 bp, Homo sapiens
cacgtttcttggagcaggttaaacatgagtgtcatttcttcaatgggacggagcgggtgcggttcctggacagatacttctataaccaggaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagag

SEQ ID NO: 2653 - DNA, 247 bp, Homo sapiens
ccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccctggtggacacctactgcagacacaactacggggttggtg

SEQ ID NO: 2654 - DNA, 251 bp, Homo sapiens
ttcttggagtactctacgtctgagtgtcatttcttcaatgggacggagcgggtgcggttcctggacagatacttctataaccaagaggaggacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcac

SEQ ID NO: 2655 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccctggtggacacctactgcagacacaactacggggttgtggagagcttcacagtgcagcggcgag

SEQ ID NO: 2656 - DNA, 240 bp, Homo sapiens
ttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacctcctggagcagaggcgggccgcggtggacacctactgcagacacaactacggggttggtgag

SEQ ID NO: 2657 - DNA, 246 bp, Homo sapiens
tttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacaattactgcagacacaactacggggttggtgagag

SEQ ID NO: 2658 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacaactactgcagacacaactacggggttggtgagagcttcacagtgcagcggcgag

SEQ ID NO: 2659 - DNA, 270 bp, Homo sapiens
cacgtttcttggagtactctacgtctgagtgtcatttcttcaatgggacggagcgggtgcggttcctggacagatacttctataaccaagaggagaacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacagtgcagcggcgag

SEQ ID NO: 2660 - DNA, 270 bp, Homo sapiens
cacgtttcttggagtactctacgtctgagtgtcatttcttcaatgggacggagcgggtgcggttcctggacagatacttctataaccaagaggagtccgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacagtgcagcggcgag

SEQ ID NO: 2661 - DNA, 269 bp, Homo sapiens
cacgtttcttggagctgcttaagtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgcggtggacacctactgcagacacaactacggggttggtgagagcttcacagtgcagcggcga

SEQ ID NO: 2662 - DNA, 283 bp, Homo sapiens
ggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagcactggaacagccagaaggacatcctggaagacaggcgggccgcggtggacacctactgcagacacaactacggggttggtgagagcttcacagtgcagcggcgag

SEQ ID NO: 2663 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacttcctggaagacaggcgggccgtggtggacacctactgcagacacaactacggggttggtgagagcttcacagtgcagcggcgag

SEQ ID NO: 2664 - DNA, 259 bp, Homo sapiens
ttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggactactggaacagccagaaggacttcctggaagacaggcgggccgcggtggacacctactgcagacacaactacggggttggtgagagcttcacagtgcagcggc

SEQ ID NO: 2665 - DNA, 269 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacctcctggagcagaggcgggccgcggtggacacctactgcagacacaactacggggttgtggagagcttcacagtgcagcggcga

SEQ ID NO: 2666 - DNA, 259 bp, Homo sapiens
ttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggactactggaacagccagaaggacttcctggaagacaggcgggccgcggtggacacctactgcagacacaactacggggttgtggagagcttcacagtgcagcggc

SEQ ID NO: 2667 - DNA, 267 bp, Homo sapiens
cgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacctcctggaagacgagcgggccgcggtggacacctactgcagacacaactacggggttgtggagagcttcacagtgcagcggcga

SEQ ID NO: 2668 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctgatgaggagtactggaacagccagaaggacttcctggaagacaggcgggccgcggtggacacctactgcagacacaactacggggttggtgagagcttcacagtgcagcggcgag

SEQ ID NO: 2669 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggggtactggaacagccagaaggacttcctggaagacaggcgggccgcggtggacacctactgcagacacaactacggggttgtggagagcttcacagtgcagcggcgag

SEQ ID NO: 2670 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgagggagctggggcggcctgatgaggagtactggaacagccagaaggacttcctggaagacaggcgggccgcggtggacacctactgcagacacaactacggggttggtgagagcttcacagtgcagcggcgag

SEQ ID NO: 2671 - DNA, 246 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgaggagtactggaacagccagaaggacttcctggaagacgagcgggccgcggtggacacctactgcagacacaactacggggttgtgg

SEQ ID NO: 2672 - DNA, 266 bp, Homo sapiens
tttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctgatgaggagtactggaacagccagaaggacttcctggaagacgagcgggccgcggtggacacctactgcagacacaactacggggttgtggagagcttcacagtgcagcggcgag

SEQ ID NO: 2673 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgaggagtactggaacagccagaaggacctcctggaagacaggcgggccgcggtggacacctactgcagacacaactacggggttgtggagagcttcacagtgcagcggcgag

SEQ ID NO: 2674 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgagggagctggggcggcctgatgaggagtactggaacagccagaaggacttcctggaagacaggcgggccgcggtggacacctactgcagacacaactacggggttgtggagagcttcacagtgcagcggcgag

SEQ ID NO: 2675 - DNA, 370 bp, Homo sapiens
atggtgtgtctgaggctccctggaggctcctgcatggcagttctgacagtgacactgatggtgctgagctccccactggctttggctggggacaccagaccacgtttcttggagtactctacgggtgagtgttatttcttcaatgggacggagcgggtgcggttactggagagacacttccataaccaggaggagctcctgcgcttcgacagcgacgtgggggagttccgggcggtgacggagctggggcggcctgtcgccgagtcctggaacagccagaaggacatcctggaagacaggcgcgccgcggtggacacctattgcagacacaactacggggctgtggagagcttcacagtgcagcggcgag

SEQ ID NO: 2676 - DNA, 370 bp, Homo sapiens
atggtgtgtctgaggctccctggaggctcctgcatggcagttctgacagtgacactgatggtgctgagctccccactggctttggctggggacaccagaccacgtttcttggagtactctacgggtgagtgttatttcttcaatgggacggagcgggtgcggttactggagagacacttccataaccaggaggagctcctgcgcttcgacagcgacgtgggggagttccgggcggtgacggagctggggcggcctgtcgccgagtcctggaacagccagaaggacatcctggaagacaggcgggccgcggtggacacctactgcagacacaactacggggctgtggagagcttcacagtgcagcggcgag

SEQ ID NO: 2677 - DNA, 270 bp, Homo sapiens
cacgtttcttggagtactctacgggtgagtgttatttcttcaatgggacggagcgggtgcggttactggagagacacttccataaccaggaggagctcctgcgcttcgacagcgacgtgggggagttccgggcggtgacggagctggggcggcctgtcgccgagtcctggaacagccagaaggacttcctggaagacaggcgcgccgcggtggacacctattgcagacacaactacggggctgtggagagcttcacagtgcagcggcgag

SEQ ID NO: 2678 - DNA, 243 bp, Homo sapiens
ttcttggagtactctacgggtgagtgttatttcttcaatgggacggagcgggtgcggttactggagagacacttccataaccaggaggagctcctgcgcttcgacagcgacgtgggggagttccgggcggtgacggagctggggcggcctgtcgccgagtcctggaacagccagaaggacttcctggaagacaggcgcgccgcggtggacacctactgcagacacaactacggggctgtggag

SEQ ID NO: 2679 - DNA, 266 bp, Homo sapiens
cacgtttcttggagtactctacgggtgagtgttatttcttcaatgggacggagcgggtgcggttactggagagacacttccataaccaggaggagctcctgcgcttcgacagcgacgtgggggagttccgggcggtgacggagctggggcggcctgtcgccgagtcctggaacagccagaaggacatcctggaagacaggcgcgccgcggtggacacctactgcagacacaactacggggttgtggagagcttcacagtgcagcgg

SEQ ID NO: 2680 - DNA, 235 bp, Homo sapiens
gagtactctacgggtgagtgttatttcttcaatgggacggagcgggtgcggttactggagagacacttccataaccaggaggagctcctgcgcttcgacagcgacgtgggggagttccgggcggtgacggagctggggcggcctgatgaggagtactggaacagccagaaggacatcctggaagacaggcgcgccgcggtggacacctattgcagacacaactacggggctgtgg

SEQ ID NO: 2681 - DNA, 270 bp, Homo sapiens
cacgtttcttggagtactctacgggtgagtgttatttcttcaatgggacggagcgggtgcggttactggagagacacttccataaccaggaggagttcctgcgcttcgacagcgacgtgggggagttccgggcggtgacggagctggggcggcctgtcgccgagtcctggaacagccagaaggacatcctggaagacaggcgcgccgcggtggacacctattgcagacacaactacggggctgtggagagcttcacagtgcagcggcgag

SEQ ID NO: 2682 - DNA, 283 bp, Homo sapiens
ggggacaccagaccacgtttcttggagtactctacgggtgagtgttatttcttcaatgggacggagcgggtgcggttactggagagacacttccataaccaggaggagctcctgcgcttcgacagcgacgtgggggagttccgggcggtgacggagctggggcggcctgtcgccgagtcctggaacagccagaaggacatcctggaagacaggcgcgccgcggtggacacctattgcagacacaactacggggctgtggagagcttcacagtgcagcggcgag

SEQ ID NO: 2683 - DNA, 270 bp, Homo sapiens
cacgtttcttggagtactctacgggtgagtgttatttcttcaatgggacggagcgggtgcggttactggagagacacttccataaccaggaggagctcctgcgcttcgacagcgacgtgggggagttccgggcggtgacggagctggggcggcctgtcgccgagtcctggaacagccagaaggacatcctgggagacaggcgcgccgcggtggacacctattgcagacacaactacggggctgtggagagcttcacagtgcagcggcgag

SEQ ID NO: 2684 - DNA, 270 bp, Homo sapiens
cacgtttcttggagtactctacgggtgagtgttatttcttcaatgggacggagcgggtgcggttcctggagagacacttccataaccaggaggagctcctgcgcttcgacagcgacgtgggggagttccgggcggtgacggagctggggcggcctgtcgccgagtcctggaacagccagaaggacatcctggaagacaggcgcgccgcggtggacacctattgcagacacaactacggggctgtggagagcttcacagtgcagcggcgag

SEQ ID NO: 2685 - DNA, 283 bp, Homo sapiens
ggggacaccagaccacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacatcctggaagacgagcgggccgcggtggacacctactgcagacacaactacggggttgtggagagcttcacagtgcagcggcgag

SEQ ID NO: 2686 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacatcctggaagacgagcgggctgcggtggacacctactgcagacacaactacggggttgtggagagcttcacagtgcagcggcgag

SEQ ID NO: 2687 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacatcctggaagacgagcgggccgcggtggacacctattgcagacacaactacggggttgtggagagcttcacagtgcagcggcgag

SEQ ID NO: 2688 - DNA, 283 bp, Homo sapiens
ggggacaccagaccacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacatcctggaagacgagcgggccgcggtggacacctactgcagacacaactacggggttggtgagagcttcacagtgcagcggcgag

SEQ ID NO: 2689 - DNA, 266 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacatcctggaagacgagcgcgccgcggtggacacctactgcagacacaactacggggttggtgagagcttcacagtgcagcgg

SEQ ID NO: 2690 - DNA, 283 bp, Homo sapiens
ggggacaccagaccacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacaagcgggccgcggtggacacctactgcagacacaactacggggttggtgagagcttcacggtgcagcggcgag

SEQ ID NO: 2691 - DNA, 262 bp, Homo sapiens
ttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacaagcgggccgcggtggacacctactgcagacacaactacggggttggtgagagcttcacagtgcagcggcgag

SEQ ID NO: 2692 - DNA, 283 bp, Homo sapiens
ggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctagcgccgagtactggaacagccagaaggacatcctggaagacgagcgggccgcggtggacacctactgcagacacaactacggggttgtggagagcttcacagtgcagcggcgag

SEQ ID NO: 2693 - DNA, 268 bp, Homo sapiens
cgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacttcctggaagacaggcgggccgcggtggacacctactgcagacacaactacggggttggtgagagcttcacagtgcagcggcgag

SEQ ID NO: 2694 - DNA, 228 bp, Homo sapiens
tgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacatcctggaagacaggcgggccgcggtggacacctactgcagacacaactacggggttgtggagagcttcaca

SEQ ID NO: 2695 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacttcctggaagacaggcgggccgcggtggacacctactgcagacacaactacggggttggtgagagcttcacagtgcagcggcgag

SEQ ID NO: 2696 - DNA, 268 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctgacgctgagtactggaacagccagaaggacttcctggaagacaggcgggccgcggtggacacctactgcagacacaactacggggttggtgagagcttcacagtgcagcggcg

SEQ ID NO: 2697 - DNA, 255 bp, Homo sapiens
ttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgatgccgagtactggaacagccagaaggacatcctggaagacgagcgggccgcggtggacacctactgcagacacaactacggggttgtggagagcttcacagtg

SEQ ID NO: 2698 - DNA, 256 bp, Homo sapiens
tttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacatcctggagcaggcgcgggccgcggtggacacctactgcagacacaactacggggttgtggagagcttcacagtg

SEQ ID NO: 2699 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacatcctggaagacaagcgggccgcggtggacacctactgcagacacaactacggggttgtggagagcttcacagtgcagcggcgag

SEQ ID NO: 2700 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgccgagtactggaacagccagaaggacttcctggaagacaggcgggccgcggtggacacctactgcagacacaactacggggttgtggagagcttcacagtgcagcggcgag

SEQ ID NO: 2701 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacaggcgggccgcggtggacacctactgcagacacaactacggggttggtgagagcttcacagtgcagcggcgag

SEQ ID NO: 2702 - DNA, 262 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacaggcgggccctggtggacacctactgcagacacaactacggggttggtgagagcttcacagtgca

SEQ ID NO: 2703 - DNA, 227 bp, Homo sapiens
tacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgccgagtactggaacagccagaaggacttcctggaagacaggcgggccgcggtggacacctactgcagacacaactacggggttggtg

SEQ ID NO: 2704 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgacgctgagtactggaacagccagaaggacttcctggaagacaggcgggccgcggtggacacctactgcagacacaactacggggttggtgagagcttcacagtgcagcggcgag

SEQ ID NO: 2705 - DNA, 266 bp, Homo sapiens
tttcttggagtactctacgtctgagtgtcatttcttcaatgggacggagcgggtgcggttcctggagagatacttccataaccaggaggagaacgtgcgcttcgacagcgacgtgggggagttccgggcggtgacggagctggggcggcctgatgccgagtactggaacagccagaaggacatcctggaagacgagcgggccgcggtggacacctactgcagacacaactacggggttgtggagagcttcacagtgcagcggcgag

SEQ ID NO: 2706 - DNA, 247 bp, Homo sapiens
ggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacatcctggaagacgagcgggccgcggtggacacctactgcagacacaactacggggttgatgagagcttcaca

SEQ ID NO: 2707 - DNA, 283 bp, Homo sapiens
ggggacaccagaccacgtttcttggagtactctacgggtgagtgttatttcttcaatgggacggagcgggtgcggttcctggacagatacttctataaccaagaggagtacgtgcgcttcgacagcgacgtgggggagttccgggcggtgacggagctggggcggcctgatgccgagtactggaacagccagaaggacatcctggaagacgagcgggccgcggtggacacctactgcagacacaactacggggttgtggagagcttcacagtgcagcggcgag

SEQ ID NO: 2708 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacttcctggaagacaggcgggccctggtggacacctactgcagacacaactacggggttgtggagagcttcacagtgcagcggcgag

SEQ ID NO: 2709 - DNA, 283 bp, Homo sapiens
ggggacaccagaccacgtttcttggagtactctacgtctgagtgtcatttcttcaatgggacggagcgggtgcggttcctggagagatacttccataaccaggaggagttcgtgcgcttcgacagcgacgtgggggagtaccgggcggtgacggagctggggcggcctgatgccgagtactggaacagccagaaggacatcctggaagacgagcgggccgcggtggacacctactgcagacacaactacggggttgtggagagcttcacagtgcagcggcgag

SEQ ID NO: 2710 - DNA, 266 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacctcctggaagacgagcgggccgcggtggacacctactgcagacacaactacggggttgtggagagcttcacagtgcagcgg

SEQ ID NO: 2711 - DNA, 283 bp, Homo sapiens
ggggacaccagaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctagcgccgagtactggaacagccagaaggacttcctggaagacaggcgggccgcggtggacacctactgcagacacaactacggggttggtgagagcttcacagtgcagcggcgag

SEQ ID NO: 2712 - DNA, 273 bp, Homo sapiens
gaccacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgccgagtactggaacagccagaaggacatcctggaagacgagcgggccgcggtggacacctactgcagacacaactacggggttgtggagagcttcacagtgcagcggcgag

SEQ ID NO: 2713 - DNA, 265 bp, Homo sapiens
cgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgccgagtactggaacagccagaaggacatcctggaagacgagcgggccgcggtggacacctactgcagacacaactacggggttggtgagagcttcacggtgcagcggc

SEQ ID NO: 2714 - DNA, 265 bp, Homo sapiens
cgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgccgagtactggaacagccagaaggacttcctggaagacgagcgggccgcggtggacacctactgcagacacaactacggggttgtggagagcttcacagtgcagcggc

SEQ ID NO: 2715 - DNA, 249 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgccgagtactggaacagccagaaggacctcctggaagacaggcgggccgcggtggacacctactgcagacacaactacggggttggtgaga

SEQ ID NO: 2716 - DNA, 270 bp, Homo sapiens
cacgtttcttggagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgag

SEQ ID NO: 2717 - DNA, 270 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacatcctggaagacgagcgggccgcggtggacacctactgcagacacaactacggggttgtggagagcttcacagtgcagcggcgag

SEQ ID NO: 2718 - DNA, 248 bp, Homo sapiens
ttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacatcctggaagacgagcgggccgcggtggacacctactgcagacacaactaccgggttgtggagagcttcac

SEQ ID NO: 2719 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacctcctggaagacgagcgggccgcggtggacacctactgcagacacaactacggggttggtgagagcttcacagtgcagcggcgag

SEQ ID NO: 2720 - DNA, 253 bp, Homo sapiens
tttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctagcgccgagtactggaacagccagaaggacatcctggaagacaggcgggccgcggtggacacctactgcagacacaactacggggttggtgagagcttcaca

SEQ ID NO: 2721 - DNA, 269 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgtcgccgagtactggaacagccagaaggacatcctggaagacgagcgggccgcggtggacacctactgcagacacaactacggggttggtgagagcttcacagtgcagcggcga

SEQ ID NO: 2722 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagtaccgggcggtgacggagctggggcggcctagcgccgagtactggaacagccagaaggacatcctggaagacgagcgggccgcggtggacacctactgcagacacaactacggggttgtggagagcttcacagtgcagcggcgag

SEQ ID NO: 2723 - DNA, 246 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacaagcgggccgcggtggacaactactgcagacacaactacggggttggtg

SEQ ID NO: 2724 - DNA, 270 bp, Homo sapiens
cacgtttcttggagtactctacgtctgagtgtcatttcttcaatgggacggagcgggtgcggttcctggacagatacttccataaccaggaggagaacctgcgcttcgacagcgacgtgggggagttccgggcggtgacggagctggggcggcctgatgccgagtactggaacagccagaaggacatcctggaagacgagcgggccgcggtggacacctactgcagacacaactacggggttggtgagagcttcacagtgcagcggcgag

SEQ ID NO: 2725 - DNA, 266 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttcctggcggtgacggagctggggcggcctgatgccgagtactggaacagccagaaggacatcctggaagacgagcgggccgcggtggacacctactgcagacacaactacggggttgtggagagcttcacagtgcagcgg

SEQ ID NO: 2726 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagtaccgggcggtgacggagctggggcggcctgatgccgagtactggaacagccagaaggacatcctggaagacgagcgggccgcggtggacacctactgcagacacaactacggggttggtgagagcttcacagtgcagcggcgag

SEQ ID NO: 2727 - DNA, 269 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacatcctggaagacaagcgggccgcggtggacacctactgcagacacaactacggggttggtgagagcttcacggtgcagcggcga

SEQ ID NO: 2728 - DNA, 245 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacgagcgggccgcggtggacacctactgcagacacaactacggggttggt

SEQ ID NO: 2729 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtcctggaacagccagaaggacatcctggaagacgagcgggccgcggtggacacctactgcagacacaactacggggttggtgagagcttcacagtgcagcggcgag

SEQ ID NO: 2730 - DNA, 260 bp, Homo sapiens
ttggagtactctacgtctgagtgtcatttcttcaatgggacggagcgggtgcggttcctggacagatacttccataaccaggaggagaacgtgcgcttcgacagcgacgtgggggagtaccgggcggtgacggagctggggcggcctgatgccgagtactggaacagccagaaggacatcctggaagacgagcgggccgcggtggacacctactgcagacacaactacggggttgtggagagcttcacagtgcagcggcg

SEQ ID NO: 2731 - DNA, 270 bp, Homo sapiens
cacgtttcttggagtactctacgtctgagtgtcatttcttcaatgggacggagcgggtgcggtacctggacagatacttccataaccaggaggagaacgtgcgcttcgacagcgacgtgggggagttccgggcggtgacggagctggggcggcctgatgccgagtactggaacagccagaaggacatcctggaagacgagcgggccgcggtggacacctactgcagacacaactacggggttggtgagagcttcacagtgcagcggcgag

SEQ ID NO: 2732 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacttcctggaagacaggcgggccgcggtggacacctactgcagacacaactacggggttgtggagagcttcacagtgcagcggcgag

SEQ ID NO: 2733 - DNA, 269 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgctgcggagcactggaacagccagaaggacctcctggaagacgagcgggccgcggtggacacctactgcagacacaactacggggttgtggagagcttcacagtgcagcggcga

SEQ ID NO: 2734 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgccgagtactggaacagccagaaggacctcctggagcagaggcgggccgcggtggacacctactgcagacacaactacggggttgtggagagcttcacagtgcagcggcgag

SEQ ID NO: 2735 - DNA, 242 bp, Homo sapiens
ttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgctgcggagcactggaacagccagaaggacatcctggaagacgagcgggccgcggtggacacctactgcagacacaactacggggttggtgagag

SEQ ID NO: 2736 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgtcgccgagtactggaacagccagaaggacttcctggaagacaggcgggccgcggtggacacctactgcagacacaactacggggttggtgagagcttcacagtgcagcggcgag

SEQ ID NO: 2737 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctgatgccgagtactggaacagccagaaggacttcctggaagacaggcgggccctggtggacacctactgcagacacaactacggggttggtgagagcttcacggtgcagcggcgag

SEQ ID NO: 2738 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacatcctggaagacgagcgggccgcggtggacacctactgcagacacaactacggggttgtggagagcttcacagtgcagcggcgag

SEQ ID NO: 2739 - DNA, 266 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacttcctggaagacaggcgggccgcggtggacacctactgcagacacaactacggggttggtgagagcttcacagtgcagcgg

SEQ ID NO: 2740 - DNA, 270 bp, Homo sapiens
cacgtttcttggagtactctacgtctgagtgtcatttcttcaatgggacggagcgggtgcggttcctggacagatacttctataaccaagaggagaacgtgcgcttcgacagcgacgtgggggagttccgggcggtgacggagctggggcggcctgatgccgagtactggaacagccagaaggacttcctggaagacaggcgggccgcggtggacacctactgcagacacaactacggggttggtgagagcttcacagtgcagcggcgag

SEQ ID NO: 2741 - DNA, 270 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcgttgacggagctggggcggcctgatgccgagtactggaacagccagaaggacatcctggaagacgagcgggccgcggtggacacctactgcagacacaactacggggttgtggagagcttcacagtgcagcggcgag

SEQ ID NO: 2742 - DNA, 260 bp, Homo sapiens
cacgtttcttggagtactctacgtctgagtgtcatttcttcaatgggacggagcgggtgcggttcctggacagatacttccataaccaggaggagtacgtgcgcttcgacagcgacgtgggggagttccgggcggtgacggagctggggcggcctgatgccgagtactggaacagccagaaggacatcctggaagacgagcgggccgcggtggacacctactgcagacacaactacggggttgtggagagcttcacagtg

SEQ ID NO: 2743 - DNA, 269 bp, Homo sapiens
cacgtttcttggagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacatcctggaagacgagcgggccgcggtggacacctactgcagacacaactacggggttgtggagagcttcacagtgcagcggcga

SEQ ID NO: 2744 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgtcgccgagtcctggaacagccagaaggacttcctggaagacgagcgggccgcggtggacacctactgcagacacaactacggggttgtggagagcttcacagtgcagcggcgag

SEQ ID NO: 2745 - DNA, 266 bp, Homo sapiens
tttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctagcgccgagtactggaacagccagaaggacttcctggaagacaggcgggccctggtggacacctactgcagacacaactacggggttggtgagagcttcacggtgcagcggcgag

SEQ ID NO: 2746 - DNA, 370 bp, Homo sapiens
atggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgaggtggacacctattgcagacacaactacggggttgtggagagcttcacagtgcagcggcgag

SEQ ID NO: 2747 - DNA, 246 bp, Homo sapiens
cacgtttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgaggtggacacctactgcagacacaactacggggttgtgg

SEQ ID NO: 2748 - DNA, 370 bp, Homo sapiens
atggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgag

SEQ ID NO: 2749 - DNA, 370 bp, Homo sapiens
atggtgtgtctgaggctccctggaggctcctgcatggcagttctgacagtgacactgatggtgctgagctccccactggctttggctggggacaccagaccacgtttcttggagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacctcctggaagacaggcgggccctggtggacacctactgcagacacaactacggggttggtgagagcttcacagtgcagcggcgag

SEQ ID NO: 2750 - DNA, 370 bp, Homo sapiens
atggtgtgtctgaggctccctggaggctcctgcatggcagttctgacagtgacactgatggtgctgagctccccactggctttggctggggacaccagaccacgtttcttggagtactctacgggtgagtgttatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgaggtggacacctattgcagacacaactacggggttgtggagagcttcacagtgcagcggcgag

SEQ ID NO: 2751 - DNA, 270 bp, Homo sapiens
cacgtttcttggagtactctacgtctgagtgtcaattcttcaatgggacggagcgggtgcggttcctggacagatacttccataaccaggaggagttcgtgcgcttcgacagcgacgtgggggagtaccgggcggtgacggagctggggcggcctgatgctgagtactggaacagccagaaggacctcctggagcggaggcgggccgaggtggacacctattgcagacacaactacggggttgtggagagcttcacagtgcagcggcgag

SEQ ID NO: 2752 - DNA, 270 bp, Homo sapiens
cacgtttcttggagtactctacgtctgagtgtcaattcttcaatgggacggagcgggtgcggttcctggacagatacttccataaccaggaggagttcgtgcgcttcgacagcgacgtgggggagtaccgggcggtgacggagctggggcggcctgatgccgagtactggaacagccagaaggacctcctggagcggaggcgggccgaggtggacacctattgcagacacaactacggggttgtggagagcttcacagtgcagcggcgag

SEQ ID NO: 2753 - DNA, 270 bp, Homo sapiens
cacgtttcttggagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttgtggagagcttcacagtgcagcggcgag

SEQ ID NO: 2754 - DNA, 269 bp, Homo sapiens
cacgtttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgaggtggacacctattgcagacacaactacggggttggtgagagcttcacagtgcagcggcga

SEQ ID NO: 2755 - DNA, 270 bp, Homo sapiens
cacgtttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgaggtggacacctattgcagacacaactacggggttggtgagagcttcacggtgcagcggcgag

SEQ ID NO: 2756 - DNA, 269 bp, Homo sapiens
cacgtttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgatgcggagcactggaacagccagaaggacctcctggagcggaggcgggccgaggtggacacctattgcagacacaactacggggttgtggagagcttcacagtgcagcggcga

SEQ ID NO: 2757 - DNA, 266 bp, Homo sapiens
tttcttggagtactctacgtctgagtgtcatttcttcaatgggacggagcgggtgcggttcctggacagatacttccataaccaggaggagaacgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgag

SEQ ID NO: 2758 - DNA, 261 bp, Homo sapiens
ttcttggagcaggttaaacatgagtgtcatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgaggtggacacctattgcagacacaactacggggttgtggagagcttcacagtgcagcgg

SEQ ID NO: 2759 - DNA, 235 bp, Homo sapiens
gagtactctacgggtgagtgttatttcttcaatgggacggagcgggtgcggttcctggacagatacttccataaccaggaggagttcgtgcgcttcgacagcgacgtgggggagtaccgggcggtgacggagctggggcggcctgatgaggagtactggaacagccagaaggacctcctggagcggaggcgggccgaggtggacacctattgcagacacaactacggggttgtgg

SEQ ID NO: 2760 - DNA, 224 bp, Homo sapiens
gtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacctcctggaagacaggcgggccctggtggacacctactgcagacacaactacggggttgtgg

SEQ ID NO: 2761 - DNA, 235 bp, Homo sapiens
gagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctagcgccgagtactggaacagccagaaggacctcctggagcagaggcgggccgcggtggacacctactgcagacacaactacggggttggtg

SEQ ID NO: 2762 - DNA, 255 bp, Homo sapiens
ttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgatgccgagtactggaacagccagaaggacctcctggagcggaggcgggccgaggtggacacctattgcagacacaactacggggttggtgagagcttcacagtg

SEQ ID NO: 2763 - DNA, 247 bp, Homo sapiens
ctctacgggtgagtgttatttcttcaatgggacggagcgggtgcggttcctggacagatacttccataaccaggaggagttcgtgcgcttcgacagcgacgtgggggagtaccgggcggtgacggagctggggcggcctgatgccgagtactggaacagccagaaggacttcctggaagacaggcgggccctggtggacacctactgcagacacaactacggggttgtggagagcttcacagtgcag

SEQ ID NO: 2764 - DNA, 240 bp, Homo sapiens
ttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacatcctggaagacgagcgggccgcggtggacacctactgcagacacaactacggggttgtggag

SEQ ID NO: 2765 - DNA, 266 bp, Homo sapiens
cacgtttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacctcctggagcagaggcgggccgcggtggacacctactgcagacacaactacggggttgtggagagcttcacagtgcagcgg

SEQ ID NO: 2766 - DNA, 258 bp, Homo sapiens
gagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgctgagtactggaacagccagaaggacctcctggagcggaggcgggccgaggtggacacctattgcagacacaactacggggttgtggagagcttcacagtgcagcggcga

SEQ ID NO: 2767 - DNA, 270 bp, Homo sapiens
ggggacaccagaccacgtttcttggagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacctcctggagcagaagcgggccgcggtggacacctactgcagacacaactacggggttggtgagagcttcaca

SEQ ID NO: 2768 - DNA, 241 bp, Homo sapiens
ttggagtactctacgtctgagtgtcatttcttcaatgggacggagcgggtgcggttcctggagagatacttccataaccaggaggagttcgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttgtggaga

SEQ ID NO: 2769 - DNA, 241 bp, Homo sapiens
ttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacctcctggagcagaagcgggccgcggtggacacctactgcagacacaactacggggttgtggaga

SEQ ID NO: 2770 - DNA, 270 bp, Homo sapiens
cacgtttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacttcctggaagacaggcgggccgcggtggacacctactgcagacacaactacggggttggtgagagcttcacagtgcagcggcgag

SEQ ID NO: 2771 - DNA, 270 bp, Homo sapiens
cacgtttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgatgccgagtactggaacagccagaaggacctcctggagcggaggcgggccgaggtggacacctattgcagacacaactacggggttgtggagagcttcacagtgcagcggcgag

SEQ ID NO: 2772 - DNA, 265 bp, Homo sapiens
ttcttggagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacatcctggagcaggcgcgggccgcggtggacacctactgcagacacaactacggggttggtgagagcttcacagtgcagcggcgag

SEQ ID NO: 2773 - DNA, 266 bp, Homo sapiens
tttcttggagtactctacgtctgagtgtcatttcttcaatgggacggagcgggtgcggttcctggacagatacttctataaccaagaggagtacgtgcgcttcgacagcgacgtgggggagtaccgggcggtgacggagctggggcggcctgctgcggagcactggaacagccagaaggacttcctggaagacaggcgggccgcggtggacacctactgcagacacaactacggggttggtgagagcttcacagtgcagcggcgag

SEQ ID NO: 2774 - DNA, 270 bp, Homo sapiens
cacgtttcttggagtactctacgtctgagtgtcatttcttcaatgggacggagcgggtgcagttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgaggtggacacctattgcagacacaactacggggttgtggagagcttcacagtgcagcggcgag

SEQ ID NO: 2775 - DNA, 270 bp, Homo sapiens
cacgtttcttggagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacttcctggaagacaggcgggccctggtggacacctactgcagacacaactacggggttggtgagagcttcacagtgcagcggcgag

SEQ ID NO: 2776 - DNA, 257 bp, Homo sapiens
cacgtttcttggagtactctacgggtgagtgttatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgaggtggacacctattgcagacacaactacggggctgtggagagcttcaca

SEQ ID NO: 2777 - DNA, 270 bp, Homo sapiens
cacgtttcttggagtactctacgtctgagtgtcatttcttcaatgggacggagcgggtgcggttcctggagagatacttccataaccaggaggagaacgtgcgcttcgacagcgacgtgggggagtaccgggcggtgacggagctggggcggcctgatgccgagtactggaacagccagaaggacctcctggagcagaggcgggccgcggtggacacctactgcagacacaactacggggctgtggagagcttcacagtgcagcggcgag

SEQ ID NO: 2778 - DNA, 253 bp, Homo sapiens
tttcttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacctcctggagcagaggcgggccgcggtggacacctactgcagacacaactacggggttggtgagagcttcaca

SEQ ID NO: 2779 - DNA, 253 bp, Homo sapiens
tttcttggagtactctacgggtgagtgttatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgcggtggacacctattgcagacacaactacggggttgtggagagcttcaca

SEQ ID NO: 2780 - DNA, 270 bp, Homo sapiens
cacgtttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgcggtggacacctactgcagacacaactacggggttgtggagagcttcacagtgcagcggcgag

SEQ ID NO: 2781 - DNA, 259 bp, Homo sapiens
ttggagtactctacgtctgagtgtcatttcttcaatgggacggagcgggtgcggttcctggacagatacttccataaccaggaggagaacgtgcgcttcgacagcgacgtgggggagttccgggcggtgacggagctggggcggcctgatgccgagtactggaacagccagaaggacctcctggagcagaggcgggccgaggtggacacctactgcagacacaactacggggttgtggagagcttcacagtgcagcggc

SEQ ID NO: 2782 - DNA, 270 bp, Homo sapiens
cacgtttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgatgcggagcactggaacagccagaaggacctcctggagcggaggcgggccgcggtggacacctattgcagacacaactacggggttgtggagagcttcacagtgcagcggcgag

SEQ ID NO: 2783 - DNA, 266 bp, Homo sapiens
cacgtttcttggagtactctacgtctgagtgtcatttcttcaatgggacggagcgggtgcggttcctggacagatacttccataaccaggaggagttcgtgcgcttcgacagcgacgtgggggagttccgggcggtgacggagctggggcggcctgctgcggagcactggaacagccagaaggacctcctggagcggaggcgggccgaggtggacacctattgcagacacaactacggggttgtggagagcttcacagtgcagcgg

SEQ ID NO: 2784 - DNA, 270 bp, Homo sapiens
cacgtttcttggagtactctacgtctgagtgtcatttcttcaatgggacggagcgggtgcggttcctggacagatacttccataaccaggaggagttcgtgcgcttcgacagcgacgtgcgggagtaccgggcggtgacggagctggggcggcctgatgccgagtactggaacagccagaaggacctcctggagcggaggcgggccgaggtggacacctattgcagacacaactacggggttggtgagagcttcacagtgcagcggcgag

SEQ ID NO: 2785 - DNA, 270 bp, Homo sapiens
cacgtttcttggagtactctacgtctgagtgtcaattcttcaatgggacggagcgggtgcggttcctggacagatacttccataaccaggaggagttcgtgcgcttcgacagcgacgtgggggagtaccgggcggtgacggagctggggcggcctgatgctgagtactggaacagccagaaggacatcctggagcaggcgcgggccgcggtggacacctactgcagacacaactacggggttgtggagagcttcacagtgcagcggcgag

SEQ ID NO: 2786 - DNA, 270 bp, Homo sapiens
cacgtttcttggagtactctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgaggtggacaattactgcagacacaactacggggttgtggagagcttcacagtgcagcggcgag

SEQ ID NO: 2787 - DNA, 270 bp, Homo sapiens
cacgtttcttggagtaccctacgtctgagtgtcatttcttcaatgggacggagcgggtgcggttcctggacagatacttccataaccaggaggagttcgtgcgcttcgacagcgacgtgggggagtaccgggcggtgacggagctggggcggcctgctgcggagcactggaacagccagaaggacctcctggagcggaggcgggccgaggtggacacctattgcagacacaactacggggttgtggagagcttcacagtgcagcggcgag

SEQ ID NO: 2788 - DNA, 270 bp, Homo sapiens
cacgtttcttggagtactctacgtctgagtgtcatttcttcaatgggacggagcgggtgcggttcctggagagatacttccataaccaggaggagttcgtgcgcttcgacagcgacgtgggggagtaccgggcggtgacggagctggggcggcctgatgccgagtactggaacagccagaaggacctcctggaagacaggcgggccctggtggacacctactgcagacacaactacggggttggtgagagcttcacagtgcagcggcgag

SEQ ID NO: 2789 - DNA, 269 bp, Homo sapiens
cacgtttcttggagtactctacgtctgagtgtcatttcttcaatgggacggagcgggtgcggttcctggagagatacttccataaccaggaggagttcctgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcga

SEQ ID NO: 2790 - DNA, 270 bp, Homo sapiens
cacgtttcttggagtactctacgtctgagtgtcatttcttcaatgggacggagcgggtgcggttcctggacagatacttctataaccaagaggagtacgtgcgcttcgacagcgacgtgggggagttccgggcggtgacggagctggggcggcctgatgccgagtactggaacagccagaaggacctcctggagcggaggcgggccgaggtggacacctattgcagacacaactacggggttggtgagagcttcacagtgcagcggcgag

SEQ ID NO: 2791 - DNA, 270 bp, Homo sapiens
cacgtttcttggagtactctacgtctgagtgtcaattcttcaatgggacggagcgggtgcggttcctggacagatacttccataaccaggaggagttcgtgcgcttcgacagcgacgtgggggagtaccgggcggtgacggagctggggcggcctgatgctgagtactggaacagccagaaggacctcctggagcggaggcgggccgaggtggacgcctattgcagacacaactacggggttgtggagagcttcacagtgcagcggcgag

SEQ ID NO: 2792 - DNA, 270 bp, Homo sapiens
cacgtttcttggagtactctacgtctgagtgtcaattcttcaatgggacggagcgggtgcggttcctggacagatacttccataaccaggaggagttcgtgcgcttcgacagcgacgtgggggagtaccgggcggtgacggagctggggcggcctgatgctgagtactggaacagccagaaggacctcctggagcggaggcgggccgaggtggacacctattgcagacacaactacggggttggtgagagcttcacagtgcagcggcgag

SEQ ID NO: 2793 - DNA, 270 bp, Homo sapiens
cacgtttcttggagtactctacgtctgagtgtcaattcttcaatgggacggagcgggtgcggttcctggacagatacttccataaccaggaggagttcgtgcgcttcgacagcgacgtgggggagtaccgggcggtgacggagctggggcggcctgatgctgagtactggaacagccagaaggacatcctggagcggaggcgggccgaggtggacacctattgcagacacaactacggggttgtggagagcttcacagtgcagcggcgag

SEQ ID NO: 2794 - DNA, 370 bp, Homo sapiens
atggtgtgtctgaagctccctggaggctcctgcatgacagcgctgacagtgacactgatggtgctgagctccccactggctttgtctggggacacccgaccacgtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccagaaggacatcctggagcaggcgcgggccgcggtggacacctactgcagacacaactacggggttgtggagagcttcacagtgcagcggcgag

SEQ ID NO: 2795 - DNA, 266 bp, Homo sapiens
cacgtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccagaaggacatcctggagcaggcgcgggccgcggtggacacctactgcagacacaactacggagttgtggagagcttcacagtgcagcgg

SEQ ID NO: 2796 - DNA, 266 bp, Homo sapiens
cacgtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccagaaggacatcctggagcaggcgcgggccgcggtggacacctattgcagacacaactacggggttgtggagagcttcacagtgcagcgg

SEQ ID NO: 2797 - DNA, 270 bp, Homo sapiens
cacgtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgatgccgagtactggaacagccagaaggacatcctggagcaggcgcgggccgcggtggacacctactgcagacacaactacggggttgtggagagcttcacagtgcagcggcgag

SEQ ID NO: 2798 - DNA, 283 bp, Homo sapiens
ggggacacccgaccacgtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccagaaggacatcctggagcaggcgcgggccgcggtggacacctactgcagacacaactacggggttggtgagagcttcacagtgcagcggcgag

SEQ ID NO: 2799 - DNA, 220 bp, Homo sapiens
gagtgtcatttcttcaatgggacggagcgggtgcggttcctggacagatacttctataaccaggaggagtccgtgcgcttcgacagcgacgtgggggagttccgggcggtgacggagctggggcggcctgatgccgagtactggaacagccagaaggacatcctggagcaggcgcgggccgcggtggacacctactgcagacacaactacggggttggtg

SEQ ID NO: 2800 - DNA, 246 bp, Homo sapiens
cacgtttcctgtggcagcctaagagggagtgtcatttcttcaatgggacggagcgggtgcggttcctggacagatacttctataatcaggaggagtccgtgcgcttcgacagcgacgtgggggagttccgggcggtgacggagctggggcggcctgacgctgagtactggaacagccagaaggacatcctggagcaggcgcgggccgcggtggacacctactgcagacacaactacggggttggtg

SEQ ID NO: 2801 - DNA, 283 bp, Homo sapiens
ggggacacccgaccacgtttcctgtggcagcctaagagggagtgtcatttcttcaatgggacggagcgggtgcggttcctggacagacacttctataaccaggaggagtccgtgcgcttcgacagcgacgtgggggagttccgggcggtgacggagctggggcggcctgacgctgagtactggaacagccagaaggacatcctggagcaggcgcgggccgcggtggacacctactgcagacacaactacggggttgtggagagcttcacagtgcagcggcgag

SEQ ID NO: 2802 - DNA, 255 bp, Homo sapiens
ttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccagaaggacttcctggagcaggcgcgggccgcggtggacacctactgcagacacaactacggggttgtggagagcttcacagtg

SEQ ID NO: 2803 - DNA, 261 bp, Homo sapiens
ttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccagaaggacctcctggagcaggcgcgggccgcggtggacacctactgcagacacaactacggggttgtggagagcttcacagtgcagcgg

SEQ ID NO: 2804 - DNA, 262 bp, Homo sapiens
ctgtggcagcctaagagggagtgtcatttcttcaatgggacggagcgggtgcggttcctggacagatacttctataaccaggaggagtccgtgcgcttcgacagcgacgtgggggagttccgggcggcgacggagctggggcggcctgacgctgagtactggaacagccagaaggacatcctggagcaggcgcgggccgcggtggacacctactgcagacacaactacggggttgtggagagcttcacagtgcagcggcgag

SEQ ID NO: 2805 - DNA, 247 bp, Homo sapiens
tttcctgtggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaggacatcctggagcaggcgcgggccgcggtggacacctactgcagacacaactacggggttgtggagagc

SEQ ID NO: 2806 - DNA, 270 bp, Homo sapiens
cacgtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccagaagaacatcctggagcaggcgcgggccgcggtggacacctactgcagacacaactacggggttggtgagagcttcacagtgcagcggcgag

SEQ ID NO: 2807 - DNA, 270 bp, Homo sapiens
cacgtttcctgtggcagcctaagagggagtgtcatttcttcaatgggacggagcgggtgcggttcctggacagatacttctataaccaggaggagtccgtgcgcttcgacagcgacgtgggggagttccaggcggtgacggagctggggcggcctgacgctgagtactggaacagccagaaggacatcctggagcaggcgcgggccgcggtggacacctactgcagacacaactacggggttgtggagagcttcacagtgcagcggcgag

SEQ ID NO: 2808 - DNA, 248 bp, Homo sapiens
gtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccagaaggacatcctggaagacgagcgggccgcggtggacacctactgcagacacaactacggggttgtggagagc

SEQ ID NO: 2809 - DNA, 270 bp, Homo sapiens
cacgtttcctgtggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaggacatcctggagcaggcgcgggccgcggtggacacctactgcagacacaactacggggttggtgagagcttcacagtgcagcggcgag

SEQ ID NO: 2810 - DNA, 271 bp, Homo sapiens
gcacgtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctagcgccgagtactggaacagccagaaggacatcctggagcaggcgcgggccgcggtggacacctactgcagacacaactacggggttgtggagagcttcacagtgcagcggcgag

SEQ ID NO: 2811 - DNA, 263 bp, Homo sapiens
cacgtttcctgtggcagcctaagagggagtgtcatttcttcaatgggacggagcgggtgcggttcctggacagatacttctataaccaggaggagtccgtgcgcttcgacagcgacgtgggggagttccgggcggtgacggagctggggcggcctgacgctgagtactggaacagccaggacatcctggagcaggcgcgggccgcggtggacacctactgcagacacaactacggggttgtggagagcttcacagtgcagcgg

SEQ ID NO: 2812 - DNA, 370 bp, Homo sapiens
atggtgtgtctgaagctccctggaggctcctgcatgacagcgctgacagtgacactgatggtgctgagctccccactggctttggctggggacacccgaccacgtttcctgtggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgag

SEQ ID NO: 2813 - DNA, 255 bp, Homo sapiens
cgtttcctgtggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaggacttcctggaagacaggcgggccgcggtggacacctactgcagacacaactacggggttggtgagagcttcaca

SEQ ID NO: 2814 - DNA, 370 bp, Homo sapiens
atggtgtgtctgaagctccctggaggctcctgcatgacagcgctgacagtgacactgatggtgctgagctccccactggctttggctggggacacccgaccacgtttcctgtggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaggacctcctggaagacaggcgcgccgcggtggacacctactgcagacacaactacggggttggtgagagcttcacagtgcagcggcgag

SEQ ID NO: 2815 - DNA, 242 bp, Homo sapiens
tttcctgtggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaggacctcctggaagacaggcgggccgcggtggacacctactgcagacacaactacggggttggtg

SEQ ID NO: 2816 - DNA, 370 bp, Homo sapiens
atggtgtgtctgaagctccctggaggctcctgcatgacagcgctgacagtgacactgatggtgctgagctccccactggctttggctggggacacccgaccacgtttcctgtggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaggacttcctggaagacagggccgccgcggtggacacctactgcagacacaactacggggttggtgagagcttcacagtgcagcggcgag

SEQ ID NO: 2817 - DNA, 235 bp, Homo sapiens
tggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaggacttcctggaagacaggcgggccctggtggacacctactgcagacacaactacggggttggtg

SEQ ID NO: 2818 - DNA, 240 bp, Homo sapiens
ctgtggcagcctaagagggagtgtcatttcttcaatgggacggagcgggtgcggttcctggacagatacttctataaccaggaggagtccgtgcgcttcgacagcgacgtgggggagtaccgggcggtgacggagctggggcggcctgacgctgagtactggaacagccagaaggacatcctggaagacaggcgcgccgcggtggacacctactgcagacacaactacggggttggtgag

SEQ ID NO: 2819 - DNA, 262 bp, Homo sapiens
cacgtttcctgtggcagcctaagagggagtgtcatttcttcaatgggacggagcgggtgcggttcccggacagatacttctataaccaggaggagtccgtgcgcttcgacagcgacgtgggggagtaccgggcggtgacggagctggggcggcctgacgctgagtactggaacagccagaaggacatcctggaagacaggcgcgccgcggtggacacctactgcagacacaactacggggttggtgagagcttcacagtgca

SEQ ID NO: 2820 - DNA, 270 bp, Homo sapiens
cacgtttcctgtggcagcctaagagggagtgtcatttcttcaatgggacggagcgggtgcggttcctggacagatacttctataaccaggaggagaacgtgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgag

SEQ ID NO: 2821 - DNA, 283 bp, Homo sapiens
ggggacacccgaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcggcgag

SEQ ID NO: 2822 - DNA, 370 bp, Homo sapiens
atggtgtgtctgaagctccctggaggctccagcttggcagcgttgacagtgacactgatggtgctgagctcccgactggctttcgctggggacacccgaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcggcgag

SEQ ID NO: 2823 - DNA, 264 bp, Homo sapiens
ggggacacccgaccacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgttgccgagtcctggaacagccagaaggacctcctggagcagaagcggggccgggtggacaattactgcagacacaactacggggttggtgagagc

SEQ ID NO: 2824 - DNA, 246 bp, Homo sapiens
cacgtttcttggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggagttggtg

SEQ ID NO: 2825 - DNA, 264 bp, Homo sapiens
ggggacacccgaccacgtttcttggagctgtgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagc

SEQ ID NO: 2826 - DNA, 251 bp, Homo sapiens
cacgtttcttggagctgcgtaagtctgagtgtcatttcttcaatgggacggagcgggtgcggtacctggagagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagc

SEQ ID NO: 2827 - DNA, 257 bp, Homo sapiens
cacgtttctcggagctgcgtaagtctgagtgtcatttcttcaatgggacggagcgggtgcggtacctggacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcaca

SEQ ID NO: 2828 - DNA, 268 bp, Homo sapiens
cacgtttcttggagctgcgtaagtctgagtgtcatttcttcaatgggacggagcgggtgcggtacctgaacagatacttccataaccaggaggagttcctgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcggcg

SEQ ID NO: 2829 - DNA, 246 bp, Homo sapiens
cacgtttcttggagctgcgtaagtctgagtgtcatttcttcaatgggacggagcgggtgcggtacctggacagatacttccataaccaggaggagttcgtgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtg

SEQ ID NO: 2830 - DNA, 246 bp, Homo sapiens
cacgtttcttggagctgcgtaagtctgagtgtcatttcttcaatgggacggagcgggtgcggtacctggacagatacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttggtg

SEQ ID NO: 2831 - DNA, 266 bp, Homo sapiens
cacgtttcttggagctgcgtaagtctgagtgtcatttcttcaatgggacggagcgggtgcggtacctggacagatacttccataaccaggaggagaacgtgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcgg

SEQ ID NO: 2832 - DNA, 266 bp, Homo sapiens
cacgtttcttggagctgcgtaagtctgagtgtcatttcttcaatgggacggagcgggtgcggttcctggagagacacttccataaccaggaggagtacgcgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcacagtgcagcgg

SEQ ID NO: 2833 - DNA, 246 bp, Homo sapiens
cacgtttcttggagctgcgtaagtctgagtgtcatttcttcaatgggacggagcgggtgcggtacctggacagatacttccataaccaggaggagttcctgagcttcgacagcgacgtgggggagtaccgggcggtgacggagctggggcggcctgtcgccgagtcctggaacagccagaaggacctcctggagcagaagcggggccgggtggacaattactgcagacacaactacggggttggtg

SEQ ID NO: 2834 - DNA, 370 bp, Homo sapiens
atggtgtgtctgaagctccctggaggctccagcttggcagcgttgacagtgacactgatggtgctgagctcccgactggctttcgctggggacacccgaccacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttgtggagagcttcacagtgcagcggcgag

SEQ ID NO: 2835 - DNA, 283 bp, Homo sapiens
ggggacacccgaccacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgagagcttcacagtgcagcggcgag

SEQ ID NO: 2836 - DNA, 246 bp, Homo sapiens
cacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaactactgcagacacaactacggggttggtg

SEQ ID NO: 2837 - DNA, 270 bp, Homo sapiens
cacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcaggcacaactacggggttggtgagagcttcacagtgcagcggcgag

SEQ ID NO: 2838 - DNA, 270 bp, Homo sapiens
cacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgcggagtactggaacagccagaaggacctcctggagcagaagcggggccaggtggacaattactgcagacacaactacggggttggtgagagcttcacagtgcagcggcgag

SEQ ID NO: 2839 - DNA, 241 bp, Homo sapiens
ttggagctgcttaagtctgagtgtcatttcttcaatgggacggagcgggtgcggttcctggagagacacttccataaccaggaggagtccgtgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgaga

SEQ ID NO: 2840 - DNA, 270 bp, Homo sapiens
cacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccgggtggacaactactgcagacacaactacggggttgtggagagcttcacagtgcagcggcgag

SEQ ID NO: 2841 - DNA, 261 bp, Homo sapiens
cgtttcttggagctgcttaagtctgagtgtcatttcttcaatgggacggagcgggtgcggttcctggagagatacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgagagcttcacagtgcag

SEQ ID NO: 2842 - DNA, 246 bp, Homo sapiens
cacgtttcttggagctgcttaagtctgagtgtcatttcttcaatgggacggagcgggtgcggttcctggagagacacttccataaccaggaggagaacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttggtg

SEQ ID NO: 2843 - DNA, 242 bp, Homo sapiens
ttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgtcgccgagtactggaacagccagaaggacctcctggagcagaagcggggccaggtggacaattactgcagacacaactacggggttggtgagag

SEQ ID NO: 2844 - DNA, 246 bp, Homo sapiens
cacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctagcgccgagtactggaacagccagaaggacctcctggagcagaagcggggccaggtggacaattactgcagacacaactacggggttggtg

SEQ ID NO: 2845 - DNA, 257 bp, Homo sapiens
cacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgacggagctggggcggcctgtcgccgagtcctggaacagccagaaggacctcctggagcagaagcggggccaggtggacaattactgcagacacaactacggggttggtgagagcttcaca

SEQ ID NO: 2846 - DNA, 283 bp, Homo sapiens
ggggacacccgaccacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgacggagctggggcggcctgatgccgagtactggaacagccagaaggacctcctggagcagaagcggggccaggtggacaattactgcagacacaactacggggttggtgagagcttcacagtgcagcggcgag

SEQ ID NO: 2847 - DNA, 283 bp, Homo sapiens
ggggacacccgaccacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacatcctggagcagaagcggggccaggtggacaattactgcagacacaactacggggttggtgagagcttcacagtgcagcggcgag

SEQ ID NO: 2848 - DNA, 270 bp, Homo sapiens
cacgtttcttgcagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgagagcttcacagtgcagcggcgag

SEQ ID NO: 2849 - DNA, 270 bp, Homo sapiens
cacgtttcttggagctgcttaagtctgagtgtcatttcttcaatgggacggagcgggtgcggctcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttggtgagagcttcacagtgcagcggcgag

SEQ ID NO: 2850 - DNA, 270 bp, Homo sapiens
cacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacaattactgcagacacaactacggggttgctgagagcttcacagtgcagcggcgag

SEQ ID NO: 2851 - DNA, 270 bp, Homo sapiens
cacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacctcctggagcagaagcggggccaggtggacacctactgcagacacaactacggggttggtgagagcttcacagtgcagcggcgag

SEQ ID NO: 2852 - DNA, 270 bp, Homo sapiens
cacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgctgcggagcactggaacagccagaaggacctcctggagcagaagcggggccaggtggacaattactgcagacacaactacggggttggtgagagcttcacagtgcagcggcgag

SEQ ID NO: 2853 - DNA, 270 bp, Homo sapiens
cacgtttcttggagctgcttaagtctgagtgtcatttcttcaatgggacggagcgggtgcggttcctggagagacacttccataaccaggaggagtacgcgcgcttcgacagcgacgtgggggagtaccgggcggtgagggagctggggcggcctgatgccgagtactggaacagccagaaggacttcctggagcagaagcggggccaggtggacaattactgcagacacaactacggggttggtgagagcttcacagtgcagcggcgag

SEQ ID NO: 2854 - DNA, 283 bp, Homo sapiens
ggggacacccgaccacgtttcttggagctgcttaagtctgagtgtcatttcttcaatgggacggagcgggtgcggttcctggagagatacttccataaccaggaggagttcgtgcgcttcgacagcgacgtgggggagtaccgggcggtgacggagctggggcggcctgtcgccgagtcctggaacagccagaaggacctcctggagcagaagcggggccaggtggacaattactgcagacacaactacggggttgtggagagcttcacagtgcagcggcgag

SEQ ID NO: 2855 - DNA, 270 bp, Homo sapiens
cacgtttcttggagctgcttaagtctgagtgtcatttcttcaatgggacggagcgggtgcggttcctggagagatacttccataaccaggaggagttcgtgcgcttcgacagcgacgtgggggagtaccgggcggtgacggagctggggcggcctgtcgccgagtcctggaacagccagaaggacctcctggagcagaagcggggccaggtggacaattactgcagacacaactacggcgttgtggagagcttcacagtgcagcggcgag

SEQ ID NO: 2856 - DNA, 246 bp, Homo sapiens
cacgtttcttggagctgcttaagtctgagtgtcatttcttcaatgggacggagcgggtgcggttcctggagagacacttccataaccaggaggagttcgtgcgcttcgacagcgacgtgggggagtaccgggcggtgacggagctggggcggcctgtcgccgagtcctggaacagccagaaggacctcctggagcagaagcggggccaggtggacaattactgcagacacaactacggggttgtgg

SEQ ID NO: 2857 - DNA, 253 bp, Homo sapiens
tttcttggagctgcttaagtctgagtgtcatttcttcaatgggacggagcgggtgcggttcctggagagatacttccataaccaggaggagttcgtgcgcttcgacagcgacgtgggggagtaccgggcggtgacggagctggggcggcctgtcgccgagtcctggaacagccagaaggacctcctggagcagaagcggggccgggtggacaattactgcagacacaactacggggttggtgagagcttcaca

SEQ ID NO: 2858 - DNA, 370 bp, Homo sapiens
atggtgtgtctgaagctccctggaggctcctgtatggcagcgctgacagtgacattgacggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgag

SEQ ID NO: 2859 - DNA, 220 bp, Homo sapiens
gagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtgggcacctactgcagatacaactacggggttgtggagagcttcacagtgcagcggcgag

SEQ ID NO: 2860 - DNA, 283 bp, Homo sapiens
ggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgag

SEQ ID NO: 2861 - DNA, 370 bp, Homo sapiens
atggtgtgtctgaagctccctggaggctcctgtatggcagcgctgacagtgacattgacggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctattgcagatacaactacggggttgtggagagcttcacagtgcagcggcgag

SEQ ID NO: 2862 - DNA, 270 bp, Homo sapiens
cacgtttcttggagcaggctaagtgtgagtgtcatttcctcaatgggacggagcgagtgtggaacctgatcagatacatctataaccaagaggagtacgcgcgctacaacagtgatctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgag

SEQ ID NO: 2863 - DNA, 270 bp, Homo sapiens
cacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacaactactgcagatacaactacggggttgtggagagcttcacagtgcagcggcgag

SEQ ID NO: 2864 - DNA, 242 bp, Homo sapiens
ttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagacacaactacggggttgtggagag

SEQ ID NO: 2865 - DNA, 270 bp, Homo sapiens
cacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgag

SEQ ID NO: 2866 - DNA, 300 bp, Homo sapiens
ggtgctgagctccccactggctttggctggggacacccaaccacgtttcttggagcaggctaagtgtgagtgtcatttcctcaatgggacggagcctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgag

SEQ ID NO: 2867 - DNA, 370 bp, Homo sapiens
atggtgtgtctgaagctccctggaggttcctacatggcaaagctgacagtgacactgatggtgctgagctccccactggctttggctggggacacccgaccacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgag

SEQ ID NO: 2868 - DNA, 257 bp, Homo sapiens
cacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaagacaggcgggccgcggtggacacctactgcagacacaactacggggttggtgagagcttcaca

SEQ ID NO: 2869 - DNA, 283 bp, Homo sapiens
ggggacacccgaccacgtttcttgcagcaggataagtatgagtgtcatttcttcaacgggacggagcgggtgcggttcctgcacagaggcatctataaccaagaggagaacgtgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgag

SEQ ID NO: 2870 - DNA, 250 bp, Homo sapiens
ttgcagcaggataagtatgagtgtcatttcttcaacgggacggagcgggtgcggttcctgcacagaggcatctataaccaagaggagaacgtgcgcttcgacagcgacgtgggggagtaccgggcggtgacggagctggggcggcctgacgctgagtactggaacagccagaaggacttcctggaagacacgcgcgccgcggtggacacctactgcagacacaactacggggttggtgagagcttcacag

SEQ ID NO: 2871 - DNA, 283 bp, Homo sapiens
ggggacacccgaccacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaagacaggcgggccctggtggacacctactgcagacacaactacggggttggtgagagcttcacagtgcagcggcgag

SEQ ID NO: 2872 - DNA, 267 bp, Homo sapiens
ccacgtttcttgcagcaggataagtatgagtgtcatttcttcaacgggacggagcgggtgcggttcctgcacagagacatctataaccaagaggaggacgtgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcgg

SEQ ID NO: 2873 - DNA, 269 bp, Homo sapiens
cacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacatcctggagcaggcgcgggccgcggtggacacctactgcagacacaactacggggctgtggagagcttcacagtgcagcggcga

SEQ ID NO: 2874 - DNA, 246 bp, Homo sapiens
cacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacatcctggaagacaggcgcgccgcggtggacacctactgcagacacaactacggggttggtg

SEQ ID NO: 2875 - DNA, 246 bp, Homo sapiens
cacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaaaacaggcgcgccgcggtggacacctactgcagacacaactacggggttggtg

SEQ ID NO: 2876 - DNA, 268 bp, Homo sapiens
cacgtttcttgcagcaggataagtatgagtgtcatttcttcaacgggacggagcgggtgcggttcctgcacagaggcatctataaccaagaggagaacgtgcgcttcgacagcgacgtgggggagtaccgggcggtgacggagctggggcggcctgacgctgagtactggaacagccagaaggacttcctggaagacaggcgcgccgcggtggacacctactgcacacaactacggggttggtgagagcttcacagtgcagcggcgag

SEQ ID NO: 2877 - DNA, 270 bp, Homo sapiens
cacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacatcctggagcaggcgcgggccgcggtggacacctactgcagacacaactacggggttggtgagagcttcacagtgcagcggcgag

SEQ ID NO: 2878 - DNA, 270 bp, Homo sapiens
cacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgccgagtcctggaacagccagaaggacttcctggagcggaggcgggccgaggtggacaccgtgtgcagacacaactacggggttggtgagagcttcacagtgcagcggcgag

SEQ ID NO: 2879 - DNA, 370 bp, Homo sapiens
atggtgtgtctgaagctccctggaggttcctacatggcagtgctgacagtgacactgatggtgctgagctccccactggctttggctggggacacccgaccatgtttcttgcagcaggataagtatgagtgtcatttcttcaacgggacggagcgggtgcggttcctgcacagaggcatctataaccaagaggagaacgtgcgcttcgacagcgacgtgggggagtaccgggcggtgacggagctggggcggcctgacgctgagtactggaacagccagaaggacatcctggagcaggcgcgggccgcggtggacacctactgcagacacaactacggggctgtggagagcttcacagtgcagcggcgag

SEQ ID NO: 2880 - DNA, 262 bp, Homo sapiens
tttcttgcagcaggataagtatgagtgtcatttcttcaacgggacggagcgggtgcggttcctgcacagaggcatctataaccaagaggagaacgtgcgcttcgacagcgacgtgggggagtaccgggcggtgacggagctggggcggcctgacgctgagtactggaacagccagaaggacatcctggagcaggcgcgggccgcggtggacacctactgcagacacaactacggggttggtgagagcttcacagtgcagcgg

SEQ ID NO: 2881 - DNA, 257 bp, Homo sapiens
catgtttcttgcagcaggataagtatgagtgtcatttcttcaacgggacggagcgggtgcggttcctgcacagaggcatctataaccaagaggagaacgtgcgcttcgacagcgacgtgggggagtaccgggcggtgacggagctggggcggcctgacgctgagtactggaacagccagaaggacttcctggagcaggcgcgggccgcggtggacacctactgcagacacaactacggggctgtggagagcttcaca

SEQ ID NO: 2882 - DNA, 270 bp, Homo sapiens
catgtttcttgcagcaggataagtatgagtgtcatttcttcaacgggacggagcgggtgcggttcctgcacagaggcatctataaccaagaggagaacgtgcgcttcgacagcgacgtgggggagtaccgggcggtgacggagctggggcggcctgacgctgagtactggaacagccagaaggacctcctggagcagaggcgggccgcggtggacacctactgcagacacaactacggggctgtggagagcttcacagtgcagcggcgag

SEQ ID NO: 2883 - DNA, 16 bp, Homo sapiens
ggtgcggttgctggaa

SEQ ID NO: 2884 - DNA, 17 bp, Homo sapiens
gcggttgctggaaagat

SEQ ID NO: 2885 - DNA, 18 bp, Homo sapiens
ctataaccaagaggagtc

SEQ ID NO: 2886 - DNA, 15 bp, Homo sapiens
ctggggcggcctgat

SEQ ID NO: 2887 - DNA, 15 bp, Homo sapiens
gggcggcctgatgcc

SEQ ID NO: 2888 - DNA, 17 bp, Homo sapiens
cacaactacggggttgg

SEQ ID NO: 2889 - DNA, 19 bp, Homo sapiens
catctataaccaagaggaa

SEQ ID NO: 2890 - DNA, 16 bp, Homo sapiens
cgcggtggacacctat

SEQ ID NO: 2891 - DNA, 16 bp, Homo sapiens
gacacaactacggggc

SEQ ID NO: 2892 - DNA, 14 bp, Homo sapiens
agaggcgggccgcc

SEQ ID NO: 2893 - DNA, 17 bp, Homo sapiens
gaacagccagaaggaca

SEQ ID NO: 2894 - DNA, 17 bp, Homo sapiens
ggacatcctggaagacg

SEQ ID NO: 2895 - DNA, 17 bp, Homo sapiens
gacatcctggaagacga

SEQ ID NO: 2896 - DNA, 16 bp, Homo sapiens
ggccgcggtggacaat

SEQ ID NO: 2897 - DNA, 17 bp, Homo sapiens
acaactacggggttgtg

SEQ ID NO: 2898 - DNA, 17 bp, Homo sapiens
cttcgacagcgacgtga

SEQ ID NO: 2899 - DNA, 15 bp, Homo sapiens
cctcctggagcaggc

SEQ ID NO: 2900 - DNA, 15 bp, Homo sapiens
cacgtttcttgtggg

SEQ ID NO: 2901 - DNA, 19 bp, Homo sapiens
tctataaccaagaggagta

SEQ ID NO: 2902 - DNA, 16 bp, Homo sapiens
gacctcctggagcagg

SEQ ID NO: 2903 - DNA, 17 bp, Homo sapiens
gacctcctggagcagaa

SEQ ID NO: 2904 - DNA, 15 bp, Homo sapiens
ggagcgggtgcggta

SEQ ID NO: 2905 - DNA, 17 bp, Homo sapiens
cctggacagatacttcc

SEQ ID NO: 2906 - DNA, 17 bp, Homo sapiens
ccataaccaggaggaga

SEQ ID NO: 2907 - DNA, 18 bp, Homo sapiens
ccataaccaggaggagaa

SEQ ID NO: 2908 - DNA, 16 bp, Homo sapiens
gcgacgtgggggagtt

SEQ ID NO: 2909 - DNA, 15 bp, Homo sapiens
gcagaagcggggccg

SEQ ID NO: 2910 - DNA, 15 bp, Homo sapiens
gggccgggtggacaa

SEQ ID NO: 2911 - DNA, 16 bp, Homo sapiens
gggccgggtggacaat

SEQ ID NO: 2912 - DNA, 13 bp, Homo sapiens
cacgtttcttgga

SEQ ID NO: 2913 - DNA, 16 bp, Homo sapiens
ggtgcggttcctggag

SEQ ID NO: 2914 - DNA, 17 bp, Homo sapiens
cctggagagatacttcc

SEQ ID NO: 2915 - DNA, 19 bp, Homo sapiens
cagatacttccataaccag

SEQ ID NO: 2916 - DNA, 17 bp, Homo sapiens
ttggtgagagcttcacg

SEQ ID NO: 2917 - DNA, 16 bp, Homo sapiens
ggtgcggtacctggac

SEQ ID NO: 2918 - DNA, 15 bp, Homo sapiens
ggggcggcctgatga

SEQ ID NO: 2919 - DNA, 15 bp, Homo sapiens
gggcggcctgatgag

SEQ ID NO: 2920 - DNA, 18 bp, Homo sapiens
cagatacttccataaccg

SEQ ID NO: 2921 - DNA, 14 bp, Homo sapiens
ctggggcggcctgc

SEQ ID NO: 2922 - DNA, 15 bp, Homo sapiens
agcagaagcggggcc

SEQ ID NO: 2923 - DNA, 15 bp, Homo sapiens
gcagaagcggggcca

SEQ ID NO: 2924 - DNA, 16 bp, Homo sapiens
ggggccaggtggacaa

SEQ ID NO: 2925 - DNA, 15 bp, Homo sapiens
ctggggcggcctagc

SEQ ID NO: 2926 - DNA, 16 bp, Homo sapiens
ggcctgatgccgagtc

SEQ ID NO: 2927 - DNA, 16 bp, Homo sapiens
gacgtgggggagttct

SEQ ID NO: 2928 - DNA, 19 bp, Homo sapiens
gtttcttggagtactctac

SEQ ID NO: 2929 - DNA, 16 bp, Homo sapiens
ggtgcggttcctggac

SEQ ID NO: 2930 - DNA, 15 bp, Homo sapiens
gtaccgggcggtgag

SEQ ID NO: 2931 - DNA, 16 bp, Homo sapiens
gggccaggtggacaat

SEQ ID NO: 2932 - DNA, 16 bp, Homo sapiens
ttcgacagcgacgtgc

SEQ ID NO: 2933 - DNA, 18 bp, Homo sapiens
ccataaccaggaggagtt

SEQ ID NO: 2934 - DNA, 17 bp, Homo sapiens
cctggacagatacttcg

SEQ ID NO: 2935 - DNA, 18 bp, Homo sapiens
ccataaccaggaggagta

SEQ ID NO: 2936 - DNA, 16 bp, Homo sapiens
atggtgtgtctgaagt

SEQ ID NO: 2937 - DNA, 20 bp, Homo sapiens
gatacttctatcaccaagaa

SEQ ID NO: 2938 - DNA, 18 bp, Homo sapiens
tcttggagcaggttaaac

SEQ ID NO: 2939 - DNA, 18 bp, Homo sapiens
ctatcaccaagaggagta

SEQ ID NO: 2940 - DNA, 15 bp, Homo sapiens
gcagaggcgggccga

SEQ ID NO: 2941 - DNA, 15 bp, Homo sapiens
gggcggcctgacgct

SEQ ID NO: 2942 - DNA, 18 bp, Homo sapiens
cttggagcaggttaaaca

SEQ ID NO: 2943 - DNA, 19 bp, Homo sapiens
ctggacagatacttctatc

SEQ ID NO: 2944 - DNA, 15 bp, Homo sapiens
gctggggcggcctag

SEQ ID NO: 2945 - DNA, 16 bp, Homo sapiens
agaggagtacgtgcgg

SEQ ID NO: 2946 - DNA, 17 bp, Homo sapiens
gcttcacagtgcagcga

SEQ ID NO: 2947 - DNA, 16 bp, Homo sapiens
cctcctggagcagaga

SEQ ID NO: 2948 - DNA, 19 bp, Homo sapiens
tttcttggagcaggttaaa

SEQ ID NO: 2949 - DNA, 15 bp, Homo sapiens
agacaggcgggccct

SEQ ID NO: 2950 - DNA, 17 bp, Homo sapiens
gaacagccagaaggact

SEQ ID NO: 2951 - DNA, 17 bp, Homo sapiens
aggacttcctggaagac

SEQ ID NO: 2952 - DNA, 15 bp, Homo sapiens
ggcggcctgatgccc

SEQ ID NO: 2953 - DNA, 16 bp, Homo sapiens
cggggttgtggagaga

SEQ ID NO: 2954 - DNA, 15 bp, Homo sapiens
ggacctcctggagcg

SEQ ID NO: 2955 - DNA, 16 bp, Homo sapiens
ctggggcggcctgata

SEQ ID NO: 2956 - DNA, 16 bp, Homo sapiens
agtaccgggcggtgat

SEQ ID NO: 2957 - DNA, 15 bp, Homo sapiens
gggggagtaccgggt

SEQ ID NO: 2958 - DNA, 14 bp, Homo sapiens
gcagaggcgggccc

SEQ ID NO: 2959 - DNA, 15 bp, Homo sapiens
gcagaggcgggccct

SEQ ID NO: 2960 - DNA, 16 bp, Homo sapiens
tcctggagcagaggca

SEQ ID NO: 2961 - DNA, 17 bp, Homo sapiens
caagaggagtacgtgca

SEQ ID NO: 2962 - DNA, 18 bp, Homo sapiens
cttggagcaggttaaacc

SEQ ID NO: 2963 - DNA, 16 bp, Homo sapiens
gacctcctggaagacg

SEQ ID NO: 2964 - DNA, 17 bp, Homo sapiens
gacctcctggaagacga

SEQ ID NO: 2965 - DNA, 17 bp, Homo sapiens
gacatcctggagcagaa

SEQ ID NO: 2966 - DNA, 15 bp, Homo sapiens
agcgacgtgggggac

SEQ ID NO: 2967 - DNA, 15 bp, Homo sapiens
ggggcggcctgatgg

SEQ ID NO: 2968 - DNA, 18 bp, Homo sapiens
tctatcaccaagaggaga

SEQ ID NO: 2969 - DNA, 18 bp, Homo sapiens
ctatcaccaagaggagaa

SEQ ID NO: 2970 - DNA, 15 bp, Homo sapiens
ggctggggacaccca

SEQ ID NO: 2971 - DNA, 14 bp, Homo sapiens
ggacaggcggggcc

SEQ ID NO: 2972 - DNA, 16 bp, Homo sapiens
ccaggtggacaccgtg

SEQ ID NO: 2973 - DNA, 17 bp, Homo sapiens
tcctgtggcagggtaaa

SEQ ID NO: 2974 - DNA, 16 bp, Homo sapiens
ggcggtgacggagcta

SEQ ID NO: 2975 - DNA, 15 bp, Homo sapiens
gcctgtcgccgagtc

SEQ ID NO: 2976 - DNA, 18 bp, Homo sapiens
gtgcagttcctggaaagt

SEQ ID NO: 2977 - DNA, 16 bp, Homo sapiens
agtcctggaacagccg

SEQ ID NO: 2978 - DNA, 14 bp, Homo sapiens
ggcggcctgctgcg

SEQ ID NO: 2979 - DNA, 16 bp, Homo sapiens
gtgacggagctagggt

SEQ ID NO: 2980 - DNA, 17 bp, Homo sapiens
ctctacgggtgagtgtt

SEQ ID NO: 2981 - DNA, 18 bp, Homo sapiens
cggttcctggacagatat

SEQ ID NO: 2982 - DNA, 16 bp, Homo sapiens
gctcctgcatggcagt

SEQ ID NO: 2983 - DNA, 16 bp, Homo sapiens
gtaccgggcggtgaca

SEQ ID NO: 2984 - DNA, 17 bp, Homo sapiens
cacaactacggggttgt

SEQ ID NO: 2985 - DNA, 18 bp, Homo sapiens
gttgttgagagcttcacg

SEQ ID NO: 2986 - DNA, 17 bp, Homo sapiens
ttgtggagagcttcacg

SEQ ID NO: 2987 - DNA, 15 bp, Homo sapiens
gctggggcggcctgt

SEQ ID NO: 2988 - DNA, 15 bp, Homo sapiens
ggcctgctgcggagc

SEQ ID NO: 2989 - DNA, 19 bp, Homo sapiens
gtttcttggagtactctag

SEQ ID NO: 2990 - DNA, 15 bp, Homo sapiens
ggcctgatgcggagc

SEQ ID NO: 2991 - DNA, 18 bp, Homo sapiens
tctataaccaagaggagg

SEQ ID NO: 2992 - DNA, 17 bp, Homo sapiens
aggacatcctggaagac

SEQ ID NO: 2993 - DNA, 15 bp, Homo sapiens
gctggggcggcctat

SEQ ID NO: 2994 - DNA, 18 bp, Homo sapiens
cttggagtactctacgtc

SEQ ID NO: 2995 - DNA, 19 bp, Homo sapiens
gtttcttggagtactctat

SEQ ID NO: 2996 - DNA, 16 bp, Homo sapiens
caactacggggctgtg

SEQ ID NO: 2997 - DNA, 17 bp, Homo sapiens
ctgtggagagcttcacg

SEQ ID NO: 2998 - DNA, 17 bp, Homo sapiens
gagcttcacagtgcaga

SEQ ID NO: 2999 - DNA, 15 bp, Homo sapiens
ctggagcggaggcgt

SEQ ID NO: 3000 - DNA, 17 bp, Homo sapiens
gttgctggaaagacgcg

SEQ ID NO: 3001 - DNA, 15 bp, Homo sapiens
ctggagcggaggcgc

SEQ ID NO: 3002 - DNA, 17 bp, Homo sapiens
gaaggacttcctggaag

SEQ ID NO: 3003 - DNA, 16 bp, Homo sapiens
cctggaagacaggcgc

SEQ ID NO: 3004 - DNA, 19 bp, Homo sapiens
tgagtgtcatttcttcaac

SEQ ID NO: 3005 - DNA, 17 bp, Homo sapiens
gacttcctggaagacga

SEQ ID NO: 3006 - DNA, 17 bp, Homo sapiens
cttggagtactctacgg

SEQ ID NO: 3007 - DNA, 16 bp, Homo sapiens
ggacctcctggaagac

SEQ ID NO: 3008 - DNA, 17 bp, Homo sapiens
ggacttcctggaagacg

SEQ ID NO: 3009 - DNA, 19 bp, Homo sapiens
tctataaccaagaggagtt

SEQ ID NO: 3010 - DNA, 19 bp, Homo sapiens
cagatacttctataaccag

SEQ ID NO: 3011 - DNA, 18 bp, Homo sapiens
ctataaccaggaggagtt

SEQ ID NO: 3012 - DNA, 18 bp, Homo sapiens
ataaccaagaggaggact

SEQ ID NO: 3013 - DNA, 14 bp, Homo sapiens
cggaggcgggccga

SEQ ID NO: 3014 - DNA, 17 bp, Homo sapiens
ccgaggtggacacctat

SEQ ID NO: 3015 - DNA, 15 bp, Homo sapiens
aagacaggcgggccc

SEQ ID NO: 3016 - DNA, 17 bp, Homo sapiens
ttggagtactctacgtc

SEQ ID NO: 3017 - DNA, 18 bp, Homo sapiens
gagtactctacgtctgag

SEQ ID NO: 3018 - DNA, 18 bp, Homo sapiens
cagaaggacttcctggaa

SEQ ID NO: 3019 - DNA, 15 bp, Homo sapiens
ggccgcggtggacaa

SEQ ID NO: 3020 - DNA, 19 bp, Homo sapiens
ttctataaccaagaggaga

SEQ ID NO: 3021 - DNA, 19 bp, Homo sapiens
tctataaccaagaggagaa

SEQ ID NO: 3022 - DNA, 16 bp, Homo sapiens
cacgtttcttggagct

SEQ ID NO: 3023 - DNA, 16 bp, Homo sapiens
cggcctgatgaggagc

SEQ ID NO: 3024 - DNA, 15 bp, Homo sapiens
agacaggcgggccgt

SEQ ID NO: 3025 - DNA, 16 bp, Homo sapiens
gcggcctgatgaggac

SEQ ID NO: 3026 - DNA, 15 bp, Homo sapiens
gcggcctgatgaggg

SEQ ID NO: 3027 - DNA, 15 bp, Homo sapiens
gttccgggcggtgag

SEQ ID NO: 3028 - DNA, 17 bp, Homo sapiens
gctcctgcatggcagtt

SEQ ID NO: 3029 - DNA, 16 bp, Homo sapiens
ttggctggggacacca

SEQ ID NO: 3030 - DNA, 16 bp, Homo sapiens
ggagcgggtgcggtta

SEQ ID NO: 3031 - DNA, 17 bp, Homo sapiens
ccataaccaggaggagc

SEQ ID NO: 3032 - DNA, 17 bp, Homo sapiens
cagaaggacatcctggg

SEQ ID NO: 3033 - DNA, 15 bp, Homo sapiens
gagcgggtgcggttc

SEQ ID NO: 3034 - DNA, 16 bp, Homo sapiens
ggaagacgagcgggct

SEQ ID NO: 3035 - DNA, 16 bp, Homo sapiens
cctggaagacgagcgc

SEQ ID NO: 3036 - DNA, 18 bp, Homo sapiens
ggacatcctggaagacaa

SEQ ID NO: 3037 - DNA, 18 bp, Homo sapiens
acgtttcttggagtactc

SEQ ID NO: 3038 - DNA, 18 bp, Homo sapiens
ggttcctggacagatact

SEQ ID NO: 3039 - DNA, 16 bp, Homo sapiens
acatcctggagcaggc

SEQ ID NO: 3040 - DNA, 17 bp, Homo sapiens
cacaactacggggttga

SEQ ID NO: 3041 - DNA, 19 bp, Homo sapiens
gagatacttccataaccag

SEQ ID NO: 3042 - DNA, 17 bp, Homo sapiens
ctgcagacacaactacc

SEQ ID NO: 3043 - DNA, 17 bp, Homo sapiens
taaccaggaggagaacc

SEQ ID NO: 3044 - DNA, 16 bp, Homo sapiens
acgtgggggagttcct

SEQ ID NO: 3045 - DNA, 15 bp, Homo sapiens
ctggggcggcctgtc

SEQ ID NO: 3046 - DNA, 15 bp, Homo sapiens
gggagttccgggcgt

SEQ ID NO: 3047 - DNA, 18 bp, Homo sapiens
cacgtttcttggagtact

SEQ ID NO: 3048 - DNA, 18 bp, Homo sapiens
tctacgtctgagtgtcaa

SEQ ID NO: 3049 - DNA, 15 bp, Homo sapiens
gggcggcctgatgct

SEQ ID NO: 3050 - DNA, 18 bp, Homo sapiens
tttcttggagtactctac

SEQ ID NO: 3051 - DNA, 16 bp, Homo sapiens
gacatcctggagcagg

SEQ ID NO: 3052 - DNA, 15 bp, Homo sapiens
gacggagcgggtgca

SEQ ID NO: 3053 - DNA, 16 bp, Homo sapiens
ggccgaggtggacaat

SEQ ID NO: 3054 - DNA, 17 bp, Homo sapiens
ttggagtaccctacgtc

SEQ ID NO: 3055 - DNA, 17 bp, Homo sapiens
taaccaggaggagttcc

SEQ ID NO: 3056 - DNA, 15 bp, Homo sapiens
gggccgaggtggacg

SEQ ID NO: 3057 - DNA, 17 bp, Homo sapiens
ctccccactggctttgt

SEQ ID NO: 3058 - DNA, 17 bp, Homo sapiens
gcagacacaactacgga

SEQ ID NO: 3059 - DNA, 18 bp, Homo sapiens
cacaactacggagttgtg

SEQ ID NO: 3060 - DNA, 16 bp, Homo sapiens
gtggcagcctaagagg

SEQ ID NO: 3061 - DNA, 20 bp, Homo sapiens
tggacagatacttctataat

SEQ ID NO: 3062 - DNA, 16 bp, Homo sapiens
cggttcctggacagac

SEQ ID NO: 3063 - DNA, 16 bp, Homo sapiens
acttcctggagcaggc

SEQ ID NO: 3064 - DNA, 15 bp, Homo sapiens
ggagttccgggcggc

SEQ ID NO: 3065 - DNA, 17 bp, Homo sapiens
ctggaacagccagaaga

SEQ ID NO: 3066 - DNA, 16 bp, Homo sapiens
acgtgggggagttcca

SEQ ID NO: 3067 - DNA, 19 bp, Homo sapiens
ctggaacagccaggggaca

SEQ ID NO: 3068 - DNA, 16 bp, Homo sapiens
tcctggaagacagggc

SEQ ID NO: 3069 - DNA, 15 bp, Homo sapiens
gcgggtgcggttccc

SEQ ID NO: 3070 - DNA, 18 bp, Homo sapiens
ctataaccaggaggagaa

SEQ ID NO: 3071 - DNA, 17 bp, Homo sapiens
cgtttcttggagctgcg

SEQ ID NO: 3072 - DNA, 16 bp, Homo sapiens
ctcccgactggctttc

SEQ ID NO: 3073 - DNA, 18 bp, Homo sapiens
cacgtttcttggagctgt

SEQ ID NO: 3074 - DNA, 17 bp, Homo sapiens
cgtttcttggagctgtg

SEQ ID NO: 3075 - DNA, 16 bp, Homo sapiens
ggtgcggtacctggag

SEQ ID NO: 3076 - DNA, 16 bp, Homo sapiens
gtttctcggagctgcg

SEQ ID NO: 3077 - DNA, 16 bp, Homo sapiens
cgggtgcggtacctga

SEQ ID NO: 3078 - DNA, 16 bp, Homo sapiens
accaggaggagtacgc

SEQ ID NO: 3079 - DNA, 17 bp, Homo sapiens
ccaggaggagttcctga

SEQ ID NO: 3080 - DNA, 12 bp, Homo sapiens
cacgtttcttgg

SEQ ID NO: 3081 - DNA, 16 bp, Homo sapiens
cggttcctggagagac

SEQ ID NO: 3082 - DNA, 18 bp, Homo sapiens
gtggacaattactgcagg

SEQ ID NO: 3083 - DNA, 15 bp, Homo sapiens
gggcggcctgatgcg

SEQ ID NO: 3084 - DNA, 18 bp, Homo sapiens
agacacttccataaccag

SEQ ID NO: 3085 - DNA, 16 bp, Homo sapiens
accaggaggagaacgc

SEQ ID NO: 3086 - DNA, 14 bp, Homo sapiens
ggagcgggtgcggc

SEQ ID NO: 3087 - DNA, 17 bp, Homo sapiens
cacaactacggggttgc

SEQ ID NO: 3088 - DNA, 17 bp, Homo sapiens
gcagacacaactacggc

SEQ ID NO: 3089 - DNA, 18 bp, Homo sapiens
gctgacagtgacattgac

SEQ ID NO: 3090 - DNA, 14 bp, Homo sapiens
cgggccgaggtggg

SEQ ID NO: 3091 - DNA, 18 bp, Homo sapiens
agtgtgagtgtcatttcc

SEQ ID NO: 3092 - DNA, 16 bp, Homo sapiens
ggagcgagtgtggaac

SEQ ID NO: 3093 - DNA, 17 bp, Homo sapiens
ggacacctactgcagat

SEQ ID NO: 3094 - DNA, 17 bp, Homo sapiens
cgcgctacaacagtgat

SEQ ID NO: 3095 - DNA, 16 bp, Homo sapiens
gggccgaggtggacaa

SEQ ID NO: 3096 - DNA, 18 bp, Homo sapiens
tggacaactactgcagat

SEQ ID NO: 3097 - DNA, 16 bp, Homo sapiens
acggagcgagtgtgga

SEQ ID NO: 3098 - DNA, 18 bp, Homo sapiens
aggttcctacatggcaaa

SEQ ID NO: 3099 - DNA, 12 bp, Homo sapiens
cacgtttcttgc

SEQ ID NO: 3100 - DNA, 19 bp, Homo sapiens
atctataaccaagaggaga

SEQ ID NO: 3101 - DNA, 16 bp, Homo sapiens
cggttcctgcacagag

SEQ ID NO: 3102 - DNA, 17 bp, Homo sapiens
gacttcctggaagacac

SEQ ID NO: 3103 - DNA, 16 bp, Homo sapiens
cctggaagacacgcgc

SEQ ID NO: 3104 - DNA, 17 bp, Homo sapiens
gaaggacatcctggaag

SEQ ID NO: 3105 - DNA, 18 bp, Homo sapiens
agaaggacttcctggaaa

SEQ ID NO: 3106 - DNA, 15 bp, Homo sapiens
gcctgacgccgagtc

SEQ ID NO: 3107 - DNA, 16 bp, Homo sapiens
aggacttcctggagcg

SEQ ID NO: 3108 - DNA, 16 bp, Homo sapiens
cgaggtggacaccgtg

SEQ ID NO: 3109 - DNA, 17 bp, Homo sapiens
ctccctggaggttccta

SEQ ID NO: 3110 - DNA, 18 bp, Homo sapiens
gttgctggaaagatgcat

SEQ ID NO: 3111 - DNA, 19 bp, Homo sapiens
ctggaaagatgcatctata

SEQ ID NO: 3112 - DNA, 15 bp, Homo sapiens
gaggagtccgtgcgc

SEQ ID NO: 3113 - DNA, 15 bp, Homo sapiens
cggcctgatgccgag

SEQ ID NO: 3114 - DNA, 17 bp, Homo sapiens
cctgatgccgagtactg

SEQ ID NO: 3115 - DNA, 16 bp, Homo sapiens
cggggttggtgagagc

SEQ ID NO: 3116 - DNA, 17 bp, Homo sapiens
caagaggaatccgtgcg

SEQ ID NO: 3117 - DNA, 18 bp, Homo sapiens
ggacacctattgcagaca

SEQ ID NO: 3118 - DNA, 16 bp, Homo sapiens
ctacggggctgtggag

SEQ ID NO: 3119 - DNA, 14 bp, Homo sapiens
gggccgccgtggac

SEQ ID NO: 3120 - DNA, 18 bp, Homo sapiens
cagaaggacatcctggaa

SEQ ID NO: 3121 - DNA, 15 bp, Homo sapiens
ggaagacgagcgggc

SEQ ID NO: 3122 - DNA, 15 bp, Homo sapiens
gaagacgagcgggcc

SEQ ID NO: 3123 - DNA, 18 bp, Homo sapiens
ggtggacaattactgcag

SEQ ID NO: 3124 - DNA, 16 bp, Homo sapiens
ggggttgtggagagct

SEQ ID NO: 3125 - DNA, 16 bp, Homo sapiens
cgacgtgagggagtac

SEQ ID NO: 3126 - DNA, 14 bp, Homo sapiens
gagcaggcgcgggc

SEQ ID NO: 3127 - DNA, 18 bp, Homo sapiens
ttcttgtgggagcttaag

SEQ ID NO: 3128 - DNA, 16 bp, Homo sapiens
agaggagtacgtgcgc

SEQ ID NO: 3129 - DNA, 14 bp, Homo sapiens
gagcaggcgcgggc

SEQ ID NO: 3130 - DNA, 15 bp, Homo sapiens
gagcagaagcgggcc

SEQ ID NO: 3131 - DNA, 8 bp, Homo sapiens
caccagac

SEQ ID NO: 3132 - DNA, 16 bp, Homo sapiens
ggtgcggtacctggac

SEQ ID NO: 3133 - DNA, 17 bp, Homo sapiens
ggtggacaactactgca

SEQ ID NO: 3134 - DNA, 14 bp, Homo sapiens
cggggccgggtgga

SEQ ID NO: 3135 - DNA, 18 bp, Homo sapiens
gttcctggagagatactt

SEQ ID NO: 3136 - DNA, 19 bp, Homo sapiens
agatacttccataaccagg

SEQ ID NO: 3137 - DNA, 16 bp, Homo sapiens
ggaggagaacgtgcgc

SEQ ID NO: 3138 - DNA, 16 bp, Homo sapiens
ggaggagaacgtgcgc

SEQ ID NO: 3139 - DNA, 17 bp, Homo sapiens
cataaccaggaggagtc

SEQ ID NO: 3140 - DNA, 15 bp, Homo sapiens
ggggagttccgggcg

SEQ ID NO: 3141 - DNA, 16 bp, Homo sapiens
agcttcacggtgcagc

SEQ ID NO: 3142 - DNA, 18 bp, Homo sapiens
gtacctggacagatactt

SEQ ID NO: 3143 - DNA, 17 bp, Homo sapiens
gcctgatgaggagtact

SEQ ID NO: 3144 - DNA, 17 bp, Homo sapiens
cctgatgaggagtactg

SEQ ID NO: 3145 - DNA, 16 bp, Homo sapiens
ccataaccgggaggag

SEQ ID NO: 3146 - DNA, 15 bp, Homo sapiens
cggcctgctgcggag

SEQ ID NO: 3147 - DNA, 15 bp, Homo sapiens
gcggggccaggtgga

SEQ ID NO: 3148 - DNA, 15 bp, Homo sapiens
cggggccaggtggac

SEQ ID NO: 3149 - DNA, 15 bp, Homo sapiens
cggcctagcgccgag

SEQ ID NO: 3150 - DNA, 15 bp, Homo sapiens
cggcctagcgccgag

SEQ ID NO: 3151 - DNA, 16 bp, Homo sapiens
tgccgagtcctggaac

SEQ ID NO: 3152 - DNA, 16 bp, Homo sapiens
ggagttctgggcggtg

SEQ ID NO: 3153 - DNA, 18 bp, Homo sapiens
agtactctacgtctgagt

SEQ ID NO: 3154 - DNA, 18 bp, Homo sapiens
gttcctggacagatactt

SEQ ID NO: 3155 - DNA, 15 bp, Homo sapiens
gcggtgagggagctg

SEQ ID NO: 3156 - DNA, 16 bp, Homo sapiens
cgacgtgcgggagttc

SEQ ID NO: 3157 - DNA, 17 bp, Homo sapiens
agaaggacatcctggag

SEQ ID NO: 3158 - DNA, 16 bp, Homo sapiens
ggaggagttcgtgcgc

SEQ ID NO: 3159 - DNA, 19 bp, Homo sapiens
agatacttcgataaccagg

SEQ ID NO: 3160 - DNA, 18 bp, Homo sapiens
ccataaccaggaggagta

SEQ ID NO: 3161 - DNA, 16 bp, Homo sapiens
ggaggagtacgtgcgc

SEQ ID NO: 3162 - DNA, 17 bp, Homo sapiens
gtctgaagttccctgga

SEQ ID NO: 3163 - DNA, 18 bp, Homo sapiens
tcaccaagaagagtacgt

SEQ ID NO: 3164 - DNA, 19 bp, Homo sapiens
caggttaaacatgagtgtc

SEQ ID NO: 3165 - DNA, 15 bp, Homo sapiens
cgggccgaggtggac

SEQ ID NO: 3166 - DNA, 17 bp, Homo sapiens
cctgacgctgagtactg

SEQ ID NO: 3167 - DNA, 19 bp, Homo sapiens
aggttaaacatgagtgtca

SEQ ID NO: 3168 - DNA, 19 bp, Homo sapiens
tacttctatcaccaagagg

SEQ ID NO: 3169 - DNA, 17 bp, Homo sapiens
tacgtgcggttcgacag

SEQ ID NO: 3170 - DNA, 15 bp, Homo sapiens
gagcagagacgggcc

SEQ ID NO: 3171 - DNA, 18 bp, Homo sapiens
gcaggttaaacatgagtg

SEQ ID NO: 3172 - DNA, 15 bp, Homo sapiens
cgggccctggtggac

SEQ ID NO: 3173 - DNA, 18 bp, Homo sapiens
cagaaggacttcctggaa

SEQ ID NO: 3174 - DNA, 16 bp, Homo sapiens
ctggaagacaggcggg

SEQ ID NO: 3175 - DNA, 17 bp, Homo sapiens
ctgatgcccagtactgg

SEQ ID NO: 3176 - DNA, 18 bp, Homo sapiens
tgtggagagattcacagt

SEQ ID NO: 3177 - DNA, 15 bp, Homo sapiens
ctggagcggaggcgg

SEQ ID NO: 3178 - DNA, 15 bp, Homo sapiens
gcgggccctggtgga

SEQ ID NO: 3179 - DNA, 17 bp, Homo sapiens
ggcctgataccgagtac

SEQ ID NO: 3180 - DNA, 16 bp, Homo sapiens
ggcggtgatggagctg

SEQ ID NO: 3181 - DNA, 16 bp, Homo sapiens
gtaccgggtggtgacg

SEQ ID NO: 3182 - DNA, 15 bp, Homo sapiens
cagaggcaggccgcg

SEQ ID NO: 3183 - DNA, 17 bp, Homo sapiens
gtacgtgcacttcgaca

SEQ ID NO: 3184 - DNA, 18 bp, Homo sapiens
caggttaaacctgagtgt

SEQ ID NO: 3185 - DNA, 18 bp, Homo sapiens
aggttaaacctgagtgtc

SEQ ID NO: 3186 - DNA, 15 bp, Homo sapiens
gtgggggactaccgg

SEQ ID NO: 3187 - DNA, 16 bp, Homo sapiens
gcctgatggcgagtac

SEQ ID NO: 3188 - DNA, 16 bp, Homo sapiens
agaggagaacgtgcgc

SEQ ID NO: 3189 - DNA, 16 bp, Homo sapiens
agaggagaacgtgcgc

SEQ ID NO: 3190 - DNA, 7 bp, Homo sapiens
acccaac

SEQ ID NO: 3191 - DNA, 16 bp, Homo sapiens
gacaccgtgtgcagac

SEQ ID NO: 3192 - DNA, 19 bp, Homo sapiens
gcagggtaaatataagtgt

SEQ ID NO: 3193 - DNA, 15 bp, Homo sapiens
acggagctagggcgg

SEQ ID NO: 3194 - DNA, 16 bp, Homo sapiens
cgccgagtcctggaac

SEQ ID NO: 3195 - DNA, 18 bp, Homo sapiens
cctggaaagtctcttcta

SEQ ID NO: 3196 - DNA, 16 bp, Homo sapiens
gaacagccggaaggac

SEQ ID NO: 3197 - DNA, 16 bp, Homo sapiens
cctgctgcggagtact

SEQ ID NO: 3198 - DNA, 16 bp, Homo sapiens
gctagggtggcctgtc

SEQ ID NO: 3199 - DNA, 19 bp, Homo sapiens
ggtgagtgttatttcttca

SEQ ID NO: 3200 - DNA, 20 bp, Homo sapiens
tggacagatatttctataac

SEQ ID NO: 3201 - DNA, 16 bp, Homo sapiens
gtgtctgaggctccct

SEQ ID NO: 3202 - DNA, 16 bp, Homo sapiens
gcggtgacagagctgg

SEQ ID NO: 3203 - DNA, 16 bp, Homo sapiens
cggggttgttgagagc

SEQ ID NO: 3204 - DNA, 15 bp, Homo sapiens
cggcctgttgccgag

SEQ ID NO: 3205 - DNA, 16 bp, Homo sapiens
tgcggagcactggaac

SEQ ID NO: 3206 - DNA, 17 bp, Homo sapiens
gtactctacgggtgagt

SEQ ID NO: 3207 - DNA, 15 bp, Homo sapiens
cggcctgctgccgag

SEQ ID NO: 3208 - DNA, 17 bp, Homo sapiens
gtactctaggggtgagt

SEQ ID NO: 3209 - DNA, 16 bp, Homo sapiens
agaggaggacgtgcgc

SEQ ID NO: 3210 - DNA, 15 bp, Homo sapiens
cggcctatcgccgag

SEQ ID NO: 3211 - DNA, 17 bp, Homo sapiens
ctctacgtctgagtgtc

SEQ ID NO: 3212 - DNA, 18 bp, Homo sapiens
agtactctatgggtgagt

SEQ ID NO: 3213 - DNA, 15 bp, Homo sapiens
ggggctgtggagagc

SEQ ID NO: 3214 - DNA, 17 bp, Homo sapiens
gtgcggtatctgcacag

SEQ ID NO: 3215 - DNA, 14 bp, Homo sapiens
ggaggcgtgccgcg

SEQ ID NO: 3216 - DNA, 18 bp, Homo sapiens
gaaagacgcgtccataac

SEQ ID NO: 3217 - DNA, 14 bp, Homo sapiens
ggaggcgcgccgcg

SEQ ID NO: 3218 - DNA, 16 bp, Homo sapiens
cctggaagacaggcgc

SEQ ID NO: 3219 - DNA, 16 bp, Homo sapiens
ctggaagacaggcgcg

SEQ ID NO: 3220 - DNA, 14 bp, Homo sapiens
acaggcgcgccgcg

SEQ ID NO: 3221 - DNA, 17 bp, Homo sapiens
ttcttcaacgggacgga

SEQ ID NO: 3222 - DNA, 17 bp, Homo sapiens
actctacgggtgagtgt

SEQ ID NO: 3223 - DNA, 18 bp, Homo sapiens
ccataaccaggaggagaa

SEQ ID NO: 3224 - DNA, 18 bp, Homo sapiens
ccataaccaggaggagtt

SEQ ID NO: 3225 - DNA, 16 bp, Homo sapiens
agaggagttcgtgcgc

SEQ ID NO: 3226 - DNA, 18 bp, Homo sapiens
ctataaccaggaggagtt

SEQ ID NO: 3227 - DNA, 16 bp, Homo sapiens
ggaggacttgcgcttc

SEQ ID NO: 3228 - DNA, 16 bp, Homo sapiens
cctggaagacaggcgg

SEQ ID NO: 3229 - DNA, 19 bp, Homo sapiens
tacgtctgagtgtcatttc

SEQ ID NO: 3230 - DNA, 17 bp, Homo sapiens
ttcctggaagacaggcg

SEQ ID NO: 3231 - DNA, 18 bp, Homo sapiens
tcttggagctgcttaagt

SEQ ID NO: 3232 - DNA, 16 bp, Homo sapiens
gcctgatgaggagcac

SEQ ID NO: 3233 - DNA, 17 bp, Homo sapiens
atgaggagcactggaac

SEQ ID NO: 3234 - DNA, 15 bp, Homo sapiens
cgggccgtggtggac

SEQ ID NO: 3235 - DNA, 18 bp, Homo sapiens
tgatgaggactactggaa

SEQ ID NO: 3236 - DNA, 17 bp, Homo sapiens
tgatgaggggtactgga

SEQ ID NO: 3237 - DNA, 18 bp, Homo sapiens
catggcagttctgacagt

SEQ ID NO: 3238 - DNA, 17 bp, Homo sapiens
gtgcggttactggagag

SEQ ID NO: 3239 - DNA, 15 bp, Homo sapiens
ggaggagctcctgcg

SEQ ID NO: 3240 - DNA, 16 bp, Homo sapiens
catcctgggagacagg

SEQ ID NO: 3241 - DNA, 16 bp, Homo sapiens
gtgcggttcctggaga

SEQ ID NO: 3242 - DNA, 15 bp, Homo sapiens
gagcgggctgcggtg

SEQ ID NO: 3243 - DNA, 15 bp, Homo sapiens
gaagacgagcgcgcc

SEQ ID NO: 3244 - DNA, 14 bp, Homo sapiens
acgagcgcgccgcg

SEQ ID NO: 3245 - DNA, 16 bp, Homo sapiens
ctggaagacaagcggg

SEQ ID NO: 3246 - DNA, 16 bp, Homo sapiens
ggaagacaagcgggcc

SEQ ID NO: 3247 - DNA, 17 bp, Homo sapiens
ggagtactctacgtctg

SEQ ID NO: 3248 - DNA, 19 bp, Homo sapiens
gacagatacttctataacc

SEQ ID NO: 3249 - DNA, 16 bp, Homo sapiens
cggggttgatgagagc

SEQ ID NO: 3250 - DNA, 17 bp, Homo sapiens
acaactaccgggttgtg

SEQ ID NO: 3251 - DNA, 15 bp, Homo sapiens
cggcctgtcgccgag

SEQ ID NO: 3252 - DNA, 16 bp, Homo sapiens
ggagaacctgcgcttc

SEQ ID NO: 3253 - DNA, 16 bp, Homo sapiens
ggagttcctggcggtg

SEQ ID NO: 3254 - DNA, 15 bp, Homo sapiens
cggcctgtcgccgag

SEQ ID NO: 3255 - DNA, 15 bp, Homo sapiens
ccgggcgttgacgga

SEQ ID NO: 3256 - DNA, 18 bp, Homo sapiens
ttggagtactctacgtct

SEQ ID NO: 3257 - DNA, 20 bp, Homo sapiens
ctgagtgtcaattcttcaat

SEQ ID NO: 3258 - DNA, 17 bp, Homo sapiens
cctgatgctgagtactg

SEQ ID NO: 3259 - DNA, 19 bp, Homo sapiens
gtttcttggagtactctac

SEQ ID NO: 3260 - DNA, 16 bp, Homo sapiens
gcgggtgcagttcctg

SEQ ID NO: 3261 - DNA, 16 bp, Homo sapiens
cgacgtgcgggagtac

SEQ ID NO: 3262 - DNA, 17 bp, Homo sapiens
ccctacgtctgagtgtc

SEQ ID NO: 3263 - DNA, 16 bp, Homo sapiens
ggaggagttcctgcgc

SEQ ID NO: 3264 - DNA, 16 bp, Homo sapiens
ggagttcctgcgcttc

SEQ ID NO: 3265 - DNA, 16 bp, Homo sapiens
ggtggacgcctattgc

SEQ ID NO: 3266 - DNA, 16 bp, Homo sapiens
ggctttgtctggggac

SEQ ID NO: 3267 - DNA, 18 bp, Homo sapiens
caactacggagttgtgga

SEQ ID NO: 3268 - DNA, 17 bp, Homo sapiens
ggagttgtggagagctt

SEQ ID NO: 3269 - DNA, 17 bp, Homo sapiens
cctaagagggagtgtca

SEQ ID NO: 3270 - DNA, 19 bp, Homo sapiens
cttctataatcaggaggag

SEQ ID NO: 3271 - DNA, 18 bp, Homo sapiens
ctggacagacacttctat

SEQ ID NO: 3272 - DNA, 17 bp, Homo sapiens
agaaggacttcctggag

SEQ ID NO: 3273 - DNA, 14 bp, Homo sapiens
cgggcggcgacgga

SEQ ID NO: 3274 - DNA, 17 bp, Homo sapiens
gccagaagaacatcctg

SEQ ID NO: 3275 - DNA, 16 bp, Homo sapiens
ggagttccaggcggtg

SEQ ID NO: 3276 - DNA, 18 bp, Homo sapiens
caagggacatcctggagc

SEQ ID NO: 3277 - DNA, 14 bp, Homo sapiens
gacagggccgccgc

SEQ ID NO: 3278 - DNA, 16 bp, Homo sapiens
gcggttcccggacaga

SEQ ID NO: 3279 - DNA, 17 bp, Homo sapiens
ggagctgcgtaagtctg

SEQ ID NO: 3280 - DNA, 16 bp, Homo sapiens
ctggctttcgctgggg

SEQ ID NO: 3281 - DNA, 18 bp, Homo sapiens
ttggagctgtgtaagtct

SEQ ID NO: 3282 - DNA, 17 bp, Homo sapiens
ggagctgtgtaagtctg

SEQ ID NO: 3283 - DNA, 18 bp, Homo sapiens
gtacctggagagatactt

SEQ ID NO: 3284 - DNA, 18 bp, Homo sapiens
cggtacctgaacagatac

SEQ ID NO: 3285 - DNA, 15 bp, Homo sapiens
gagcagaagcggggc

SEQ ID NO: 3286 - DNA, 16 bp, Homo sapiens
ggagtacgcgcgcttc

SEQ ID NO: 3287 - DNA, 17 bp, Homo sapiens
agttcctgagcttcgac

SEQ ID NO: 3288 - DNA, 18 bp, Homo sapiens
cgtttcttggagctgctt

SEQ ID NO: 3289 - DNA, 18 bp, Homo sapiens
ctggagagacacttccat

SEQ ID NO: 3290 - DNA, 18 bp, Homo sapiens
ttactgcaggcacaacta

SEQ ID NO: 3291 - DNA, 17 bp, Homo sapiens
cctgatgcggagtactg

SEQ ID NO: 3292 - DNA, 15 bp, Homo sapiens
ggaggagaacgcgcg

SEQ ID NO: 3293 - DNA, 16 bp, Homo sapiens
ggagaacgcgcgcttc

SEQ ID NO: 3294 - DNA, 18 bp, Homo sapiens
cgtttcttgcagctgctt

SEQ ID NO: 3295 - DNA, 15 bp, Homo sapiens
ggtgcggctcctgga

SEQ ID NO: 3296 - DNA, 16 bp, Homo sapiens
cggggttgctgagagc

SEQ ID NO: 3297 - DNA, 17 bp, Homo sapiens
aactacggcgttgtgga

SEQ ID NO: 3298 - DNA, 17 bp, Homo sapiens
gacattgacggtgctga

SEQ ID NO: 3299 - DNA, 16 bp, Homo sapiens
cgaggtgggcacctac

SEQ ID NO: 3300 - DNA, 17 bp, Homo sapiens
gtgtggaacctgatcag

SEQ ID NO: 3301 - DNA, 18 bp, Homo sapiens
ggacacctattgcagata

SEQ ID NO: 3302 - DNA, 17 bp, Homo sapiens
aacagtgatctggggga

SEQ ID NO: 3303 - DNA, 19 bp, Homo sapiens
tactgcagatacaactacg

SEQ ID NO: 3304 - DNA, 18 bp, Homo sapiens
tgtcatttcctcaatggg

SEQ ID NO: 3305 - DNA, 17 bp, Homo sapiens
gagtgtggaacctgatc

SEQ ID NO: 3306 - DNA, 17 bp, Homo sapiens
catggcaaagctgacag

SEQ ID NO: 3307 - DNA, 18 bp, Homo sapiens
cgtttcttgcagcaggat

SEQ ID NO: 3308 - DNA, 18 bp, Homo sapiens
ctgcacagaggcatctat

SEQ ID NO: 3309 - DNA, 15 bp, Homo sapiens
gaagacacgcgcgcc

SEQ ID NO: 3310 - DNA, 14 bp, Homo sapiens
acacgcgcgccgcg

SEQ ID NO: 3311 - DNA, 16 bp, Homo sapiens
cctggaaaacaggcgc

SEQ ID NO: 3312 - DNA, 17 bp, Homo sapiens
aggttcctacatggcag

SEQ ID NO: 3313 - DNA, 18 bp, Homo sapiens
tgtttcttgcagcaggat

SEQ ID NO: 3314 - DNA, 20 bp, Homo sapiens
agagtactccaagaaacgtg

SEQ ID NO: 3315 - DNA, 18 bp, Homo sapiens
ccgctgcaccgtgaagct

SEQ ID NO: 3316 - DNA, 18 bp, Homo sapiens
tcgctgcactgtgaagct

SEQ ID NO: 3317 - DNA, 18 bp, Homo sapiens
cctctgcactgtgaagct

SEQ ID NO: 3318 - DNA, 27 bp, Homo sapiens
ccggatccttcgtgtccccacagcacg

SEQ ID NO: 3319 - DNA, 21 bp, Homo sapiens
aaccccgtagttgtgtctgca

SEQ ID NO: 3320 - DNA, 18 bp, Homo sapiens
tgggacagagagaccaga

SEQ ID NO: 3321 - DNA, 19 bp, Homo sapiens
tcccaaaacctggagacta

SEQ ID NO: 3322 - DNA, 20 bp, Homo sapiens
ggaactacggcgatatctaa

SEQ ID NO: 3323 - DNA, 19 bp, Homo sapiens
cggcgatatctaaaatccg

SEQ ID NO: 3324 - DNA, 19 bp, Homo sapiens
cctggaatatcacactgag

SEQ ID NO: 3325 - DNA, 25 bp, Homo sapiens
tatttttgttattattattttctac

SEQ ID NO: 3326 - DNA, 17 bp, Homo sapiens
cctcacggtgctgtccg

SEQ ID NO: 3327 - DNA, 18 bp, Homo sapiens
gtgaatgtcacccgcagt

SEQ ID NO: 3328 - DNA, 18 bp, Homo sapiens
cgtagtcctgaggagaag

SEQ ID NO: 3329 - DNA, 18 bp, Homo sapiens
tcagcctctgatgtcagc

SEQ ID NO: 3330 - DNA, 17 bp, Homo sapiens
cagcccttcctgcgcta

SEQ ID NO: 3331 - DNA, 19 bp, Homo sapiens
gagactgaggaatggacag

SEQ ID NO: 3332 - DNA, 19 bp, Homo sapiens
cccggaatatcacactgac

SEQ ID NO: 3333 - DNA, 17 bp, Homo sapiens
gccaccaggatttgccg

SEQ ID NO: 3334 - DNA, 20 bp, Homo sapiens
gcgatatctagaatccagca

SEQ ID NO: 3335 - DNA, 17 bp, Homo sapiens
gggacagagagaccagg

SEQ ID NO: 3336 - DNA, 18 bp, Homo sapiens
cccaaaacctggagactg

SEQ ID NO: 3337 - DNA, 19 bp, Homo sapiens
gtttctgctgttgctgctg

SEQ ID NO: 3338 - DNA, 17 bp, Homo sapiens
agacctgggtggccact

SEQ ID NO: 3339 - DNA, 17 bp, Homo sapiens
tgctgctggctgctgct

SEQ ID NO: 3340 - DNA, 16 bp, Homo sapiens
cacccgcagcgaggca

SEQ ID NO: 3341 - DNA, 19 bp, Homo sapiens
ctcttcctctcccaaaacg

SEQ ID NO: 3342 - DNA, 20 bp, Homo sapiens
gctcccagcatttctactat

SEQ ID NO: 3343 - DNA, 19 bp, Homo sapiens
cggcgatatctagaatcca

SEQ ID NO: 3344 - DNA, 17 bp, Homo sapiens
gtcagctcttgggtccg

SEQ ID NO: 3345 - DNA, 19 bp, Homo sapiens
ccatgaagaccaagacact

SEQ ID NO: 3346 - DNA, 18 bp, Homo sapiens
tgccaaggagaggagcaa

SEQ ID NO: 3347 - DNA, 19 bp, Homo sapiens
gaactacggcgatatctag

SEQ ID NO: 3348 - DNA, 20 bp, Homo sapiens
ccagcatttctactacgata

SEQ ID NO: 3349 - DNA, 17 bp, Homo sapiens
gctgcagagggtccagg

SEQ ID NO: 3350 - DNA, 17 bp, Homo sapiens
ctggcgtcaggatgggc

SEQ ID NO: 3351 - DNA, 17 bp, Homo sapiens
ggcttgcattccctccg

SEQ ID NO: 3352 - DNA, 18 bp, Homo sapiens
cccagttgggacgagtgt

SEQ ID NO: 3353 - DNA, 17 bp, Homo sapiens
ctgctgctgctgctgct

SEQ ID NO: 3354 - DNA, 19 bp, Homo sapiens
agaagatgtcctgggaaac

SEQ ID NO: 3355 - DNA, 19 bp, Homo sapiens
tgtgcagtcagggtttctt

SEQ ID NO: 3356 - DNA, 18 bp, Homo sapiens
gcctcagagggcaacatc

SEQ ID NO: 3357 - DNA, 17 bp, Homo sapiens
ctgctgctgctgctgct

SEQ ID NO: 3358 - DNA, 20 bp, Homo sapiens
ttctatccccggaatatcat

SEQ ID NO: 3359 - DNA, 18 bp, Homo sapiens
gttgctgctgctgctgct

SEQ ID NO: 3360 - DNA, 19 bp, Homo sapiens
cagaccttggccatgaaca

SEQ ID NO: 3361 - DNA, 18 bp, Homo sapiens
ggaatcacagcactcacg

SEQ ID NO: 3362 - DNA, 20 bp, Homo sapiens
acggcgatatctaaaatcca

SEQ ID NO: 3363 - DNA, 19 bp, Homo sapiens
ctctcccaaaacctggagt

SEQ ID NO: 3364 - DNA, 19 bp, Homo sapiens
ttcttgaaggaagatgccg

SEQ ID NO: 3365 - DNA, 20 bp, Homo sapiens
catgaagacaacagcaccaa

SEQ ID NO: 3366 - DNA, 17 bp, Homo sapiens
gggtttctcgctgaggg

SEQ ID NO: 3367 - DNA, 18 bp, Homo sapiens
caaggagaggagcagagt

SEQ ID NO: 3368 - DNA, 17 bp, Homo sapiens
ggccaccaggatttgcg

SEQ ID NO: 3369 - DNA, 18 bp, Homo sapiens
cagggcttctggcttctg

SEQ ID NO: 3370 - DNA, 20 bp, Homo sapiens
agaaaacatcagctgcagat

SEQ ID NO: 3371 - DNA, 19 bp, Homo sapiens
atcaacacccagttgggat

SEQ ID NO: 3372 - DNA, 19 bp, Homo sapiens
agagaccagagacttgaca

SEQ ID NO: 3373 - DNA, 19 bp, Homo sapiens
ctggagactaaggaatgga

SEQ ID NO: 3374 - DNA, 19 bp, Homo sapiens
cgatatctaaaatccggcg

SEQ ID NO: 3375 - DNA, 19 bp, Homo sapiens
ctaaaatccggcgtagtcc

SEQ ID NO: 3376 - DNA, 17 bp, Homo sapiens
cacactgagctggcgtc

SEQ ID NO: 3377 - DNA, 22 bp, Homo sapiens
attattttctacgtctgttgtt

SEQ ID NO: 3378 - DNA, 17 bp, Homo sapiens
tgctgtccggggatgga

SEQ ID NO: 3379 - DNA, 17 bp, Homo sapiens
acccgcagtgaggcctc

SEQ ID NO: 3380 - DNA, 17 bp, Homo sapiens
gaggagaagagtgcccc

SEQ ID NO: 3381 - DNA, 19 bp, Homo sapiens
tgatgtcagctcttgggtc

SEQ ID NO: 3382 - DNA, 17 bp, Homo sapiens
cctgcgctatgacaggc

SEQ ID NO: 3383 - DNA, 18 bp, Homo sapiens
gaatggacagtgccccag

SEQ ID NO: 3384 - DNA, 17 bp, Homo sapiens
cacactgacctggcgtc

SEQ ID NO: 3385 - DNA, 18 bp, Homo sapiens
ggatttgccgaggagagg

SEQ ID NO: 3386 - DNA, 19 bp, Homo sapiens
gaatccagcatagtcctga

SEQ ID NO: 3387 - DNA, 18 bp, Homo sapiens
agagaccagggacttgac

SEQ ID NO: 3388 - DNA, 18 bp, Homo sapiens
ctggagactgaggaatgg

SEQ ID NO: 3389 - DNA, 17 bp, Homo sapiens
gttgctgctggctgctg

SEQ ID NO: 3390 - DNA, 18 bp, Homo sapiens
ggtggccactaggatttg

SEQ ID NO: 3391 - DNA, 17 bp, Homo sapiens
gctgctggctgctgcta

SEQ ID NO: 3392 - DNA, 17 bp, Homo sapiens
agcgaggcatcagaggg

SEQ ID NO: 3393 - DNA, 19 bp, Homo sapiens
tcccaaaacgtggagactg

SEQ ID NO: 3394 - DNA, 20 bp, Homo sapiens
atttctactatgatggggag

SEQ ID NO: 3395 - DNA, 19 bp, Homo sapiens
ctagaatccagcgtagtcc

SEQ ID NO: 3396 - DNA, 16 bp, Homo sapiens
tgggtccgctggctcc

SEQ ID NO: 3397 - DNA, 19 bp, Homo sapiens
ccaagacactctatcacgc

SEQ ID NO: 3398 - DNA, 19 bp, Homo sapiens
agaggagcaaaggttcacc

SEQ ID NO: 3399 - DNA, 19 bp, Homo sapiens
cgatatctagaatccggcg

SEQ ID NO: 3400 - DNA, 19 bp, Homo sapiens
tactacgatagggagctct

SEQ ID NO: 3401 - DNA, 16 bp, Homo sapiens
gggtccagggctcgtg

SEQ ID NO: 3402 - DNA, 19 bp, Homo sapiens
caggatgggctatctttga

SEQ ID NO: 3403 - DNA, 19 bp, Homo sapiens
attccctccgggagattag

SEQ ID NO: 3404 - DNA, 18 bp, Homo sapiens
tgctgctgctgctgctat

SEQ ID NO: 3405 - DNA, 20 bp, Homo sapiens
ctgctgctgctatttttgtt

SEQ ID NO: 3406 - DNA, 19 bp, Homo sapiens
cctgggaaacaagacatgg

SEQ ID NO: 3407 - DNA, 19 bp, Homo sapiens
agggtttcttgctgaggta

SEQ ID NO: 3408 - DNA, 18 bp, Homo sapiens
gggcaacatcaccgtgac

SEQ ID NO: 3409 - DNA, 18 bp, Homo sapiens
gctgctgctgctgctatt

SEQ ID NO: 3410 - DNA, 20 bp, Homo sapiens
cggaatatcatactgacctg

SEQ ID NO: 3411 - DNA, 20 bp, Homo sapiens
gccatgaacatcaggaattt

SEQ ID NO: 3412 - DNA, 17 bp, Homo sapiens
gcactcacgctgtgccc

SEQ ID NO: 3413 - DNA, 19 bp, Homo sapiens
ctaaaatccagcgtagtcc

SEQ ID NO: 3414 - DNA, 19 bp, Homo sapiens
aacctggagtctgaggaat

SEQ ID NO: 3415 - DNA, 18 bp, Homo sapiens
gaagatgccgtgaagacc

SEQ ID NO: 3416 - DNA, 17 bp, Homo sapiens
cagcaccaagagctccc

SEQ ID NO: 3417 - DNA, 17 bp, Homo sapiens
cgctgagggacatctgg

SEQ ID NO: 3418 - DNA, 18 bp, Homo sapiens
ggagcagagtttcacctg

SEQ ID NO: 3419 - DNA, 19 bp, Homo sapiens
aggatttgcgaaggagagg

SEQ ID NO: 3420 - DNA, 18 bp, Homo sapiens
ctggcttctgtccctgga

SEQ ID NO: 3421 - DNA, 18 bp, Homo sapiens
agctgcagatggtccaga

SEQ ID NO: 3422 - DNA, 18 bp, Homo sapiens
cagttgggatgagtgacc

SEQ ID NO: 3423 - DNA, 22 bp, Homo sapiens
agtggagccagtggacccaaga

SEQ ID NO: 3424 - DNA, 23 bp, Homo sapiens
tgatgttttcttcttacaacaac

SEQ ID NO: 3425 - DNA, 22 bp, Homo sapiens
gtcttcgttataacctcacggt

SEQ ID NO: 3426 - DNA, 22 bp, Homo sapiens
gctcgtgagcctgcaggtcctg

SEQ ID NO: 3427 - DNA, 22 bp, Homo sapiens
agtggagccagtggacccaaga

SEQ ID NO: 3428 - DNA, 1082 bp, Homo sapiens
  misc_feature (873)..(875): n is a, c, g, or t
  misc_feature (882)..(899): n is a, c, g, or t
gtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactaaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctnnngctgctnnnnnnnnnnnnnnnnnnatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccact

SEQ ID NO: 3429 - DNA, 1076 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctgctgctgctatttttgttattattattttctacgtctgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccact

SEQ ID NO: 3430 - DNA, 813 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagtgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3431 - DNA, 1067 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacgtggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccact

SEQ ID NO: 3432 - DNA, 812 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctct

SEQ ID NO: 3433 - DNA, 1067 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacgtggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcatagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccact

SEQ ID NO: 3434 - DNA, 945 bp, Homo sapiens
gtcttcgttataacctcacggtgctgtcctgggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagtgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccag

SEQ ID NO: 3435 - DNA, 813 bp, Homo sapiens
gtcttcgttataacctcacggtgctgtcctgggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3436 - DNA, 1065 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccact

SEQ ID NO: 3437 - DNA, 949 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccactaggatttgccgaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaagaagaaaacatcagctgcagagggtccag

SEQ ID NO: 3438 - DNA, 813 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcatcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctg

SEQ ID NO: 3439 - DNA, 1067 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacgtggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccact

SEQ ID NO: 3440 - DNA, 1067 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactatgatggggagctcttcctctcccaaaacgtggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccact

SEQ ID NO: 3441 - DNA, 1064 bp, Homo sapiens
gtcttccttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccact

SEQ ID NO: 3442 - DNA, 1067 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccgtgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcacgctgtgccctctgggaaagtgctggtgcttcagagtcattggcagacattccatgtttctgctgttgctgctgctgctgctgctatttttgttattattattttctatgtctgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccgctggctccact

SEQ ID NO: 3443 - DNA, 1061 bp, Homo sapiens
gtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacactctatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccact

SEQ ID NO: 3444 - DNA, 813 bp, Homo sapiens
gtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacactctatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcaaaggttcacctgctacatggaacacagcgggaatcacagcactcaccctgtgccctctg

SEQ ID NO: 3445 - DNA, 812 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctct

SEQ ID NO: 3446 - DNA, 812 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatagggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaagagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctct

SEQ ID NO: 3447 - DNA, 969 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatagggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctggaaagtgctggtgcttcagagtcattggcagacattccatgtttctgctgttgctgctgctgctgctgctgctgctgctatttttgttattattattttctacgtctgttgttgtaagaagaaaacatcagctgcagagggtccagggctcgtgag

SEQ ID NO: 3448 - DNA, 1064 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaacagtgccccccatggtgaatgtcacccgcagcgaggcctcagagggcaacatcaccgtgacatgcagggcttccagcttctatccccggaatatcatactgacctggcgtcaggatgggctatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagctcttgggtccactggctccact

SEQ ID NO: 3449 - DNA, 969 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccgggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctggaaagtgctggtgcttcagagtcattggcagacattccatgtttctgctgttgctgctgctgctgctgctgctgctgctatttttgttattattattttctacgtctgttgttgtaagaagaaaacatcagctgcagagggtccagggctcgtgag

SEQ ID NO: 3450 - DNA, 1061 bp, Homo sapiens
gtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaataagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccagagctcgtgagcctgcaggtcctggatcaacacccagttgggacgagtgaccacagggatgccacacagctcggatttcagcctctgatgtcagatcttgggtccactggctccact

SEQ ID NO: 3451 - DNA, 997 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccagagctcgtgagcctgcaggtcctggatcaacacccagttgggacgagtgt

SEQ ID NO: 3452 - DNA, 963 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctgctgctgctgctatttttgttattattattttctacgtctgttgttgtaagaagaaaacatcagctgcagagggtccag

SEQ ID NO: 3453 - DNA, 813 bp, Homo sapiens
gtcttcgttataacctcacggtgctgtcctgggatggatctgtgcagtcagggtttctcactgaggtacatctggatggtcagcccttcctgcgctgtgacaggcagaaatgcagggcaaagccccagggacagtgggcagaagatgtcctgggaaacaagacatgggacagagagaccagagacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacactctatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3454 - DNA, 813 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctg

SEQ ID NO: 3455 - DNA, 920 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaa

SEQ ID NO: 3456 - DNA, 813 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3457 - DNA, 813 bp, Homo sapiens
gtcttccttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3458 - DNA, 951 bp, Homo sapiens
gtcttcgttataacctcacggtgctgtcctgggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagtgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccag

SEQ ID NO: 3459 - DNA, 948 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccag

SEQ ID NO: 3460 - DNA, 920 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctggctgctgctatttttgttattattattttctatgtccgttgttgtaa

SEQ ID NO: 3461 - DNA, 945 bp, Homo sapiens
gtcttcgttataacctcacggtgctgtcctgggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacatcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccag

SEQ ID NO: 3462 - DNA, 813 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcacgctgtgccctctg

SEQ ID NO: 3463 - DNA, 813 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactaaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3464 - DNA, 813 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacactctatcacgctatgcatgcagactgcctgcaggaactacggcgatatctaaaatccagcgtagtcctgaggagaagagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3465 - DNA, 948 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagtctgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagagggtccag

SEQ ID NO: 3466 - DNA, 813 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccgtgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3467 - DNA, 813 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctg

SEQ ID NO: 3468 - DNA, 813 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaagagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3469 - DNA, 813 bp, Homo sapiens
gtcttcgttataacctcacggtgctgtcctgggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctg

SEQ ID NO: 3470 - DNA, 813 bp, Homo sapiens
gtcttcgttataacctcacggtgctgtcctgggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3471 - DNA, 813 bp, Homo sapiens
gtcttcgttataacctcacggtgctgtcctgggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatgggctatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctg

SEQ ID NO: 3472 - DNA, 813 bp, Homo sapiens
gtcttcgttataacctcacggtgctgtcctgggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactaaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3473 - DNA, 960 bp, Homo sapiens
gtcttcgttataacctcacggtgctgtccggggatggatctgtgcagtcagggtttctcgctgagggacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctgctgctgctatttttgttattattattttctacgtctgttgttgtaagaagaaaacatcagctgcagagggtccag

SEQ ID NO: 3474 - DNA, 813 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccactaggatttgccgaggagaggagcagaggttcacctgctacatggaacacagcgggaatcacagcactcaccctgtgccctctg

SEQ ID NO: 3475 - DNA, 945 bp, Homo sapiens
gtcttcgttataacctcacggtgctgtcctgggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacgctatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagagtttcacctgctacatggaacacagcgggaatcacagcactcaccctgtgccctctgggaaagtgctggtgcttcagagtcattggcagacattccatgtttctgctgttgctgctgctgctatttttgttattattattttctatgtctgttgttgtaagaagaaaacatcagctgcagagggtccag

SEQ ID NO: 3476 - DNA, 813 bp, Homo sapiens
gtcttcgttataacctcacggtgctgtccggggatggatctgtgcagtcagggtttctcgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacgtggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaagagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctg

SEQ ID NO: 3477 - DNA, 945 bp, Homo sapiens
gtcttcgttataacctcacggtgctgtcctgggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagtgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgcgaaggagaggagcagaggttcacctgctacatggaacacagcgggaatcacagcactcaccctgtgccctctgggaaagtgctggtgcttcagagtcattggcagacattccatgtttctgctgttgctgctgctgctatttttgttattattattttctatgtccgttgttgtaagaagaaaacatcagctgcagagggtccag

SEQ ID NO: 3478 - DNA, 960 bp, Homo sapiens
gtcttcgttataacctcacggtgctgtccggggatggatctgtgcagtcagggtttctcgctgaggtacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctgtccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctgctgctgctatttttgttattattattttctacgtctgttgttgtaagaagaaaacatcagctgcagagggtccag

SEQ ID NO: 3479 - DNA, 951 bp, Homo sapiens
gtcttcgttataacctcacggtgctgtccggggatggatctgtgcagtcagggtttctcgctgagggacatctggatggtcagcccttcctgcgctgtgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacaatgccccagtcctccagagctcagaccttggccatgaacgtcaggaatttcttgaaggaagatgccatgaagaccaagacacactatcacgctatgcatgcagactgcctgcaggaactacggcgatatctaaaatccggcgtagtcctgaggagaacagtgccccccatggtgaatgtcacccgcagcgaggcctcagagggcaacattaccgtgacatgcagggcttctggcttctatccctggaatatcacactgagctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcacgctgtgccctctgggaaagtgctggtgcttcagagtcattggcagacattccatgtttctgctgttgctgctgctgctgctgctatttttgttattattattttctatgtctgttgttgtaagaagaaaacatcagctgcagagggtccag

SEQ ID NO: 3480 - DNA, 1064 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctgggaaagtgctggtgcttcagagtcattggcagacattccatgtttctgctgttgctgctgctgctgctatttttgttattattattttctatgtccgttgttgtaagaagaaaacatcagctgcagatggtccagagctcgtgagcctgcaggtcctggatcaacacccagttgggacgagtgaccacagggatgccacacagctcggatttcagcctctgatgtcagctcttgggtccactggctccact

SEQ ID NO: 3481 - DNA, 1067 bp, Homo sapiens
gtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggcttgcattccctccaggagattagggtctgtgagatccatgaagacaacagcaccaggagctcccagcatttctactacgatggggagctcttcctctcccaaaacgtggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccagcgtagtcctgaggagaacagtgccccccatggtgaatgtcacccgcagcgaggcctcagagggcaacatcaccgtgacatgcagggcttccagcttctatccccggaatatcacactgacctggcgtcaggatggggtatctttgagccacgacacccagcagtggggggatgtcctgcctgatgggaatggaacctaccagacctgggtggccaccaggatttgccaaggagaggagcagaggttcacctgctacatggaacacagcgggaatcacagcactcaccctgtgccctctgggaaagtgctggtgcttcagagtcattggcagacattccatgtttctgctgttgctgctgctgctgctgctatttttgttattattattttctatgtccgttgttgtaagaagaaaacatcagctgcagagggtccagagctcgtgagcctgcaggtcctggatcaacacccagttgggatgagtgaccacagggatgccacacagctcggatttcagcctctgatgtcagctcttgggtccactggctccact

The invention claimed is:

1. A probe set comprising multiple probes that are isolated and that can be used for identification of an HLA-A allele contained in a specimen, wherein the multiple probes comprise SEQ ID NOs. 251 to 454 or SEQ ID NOs. 455 to 631 so that the alleles of SEQ ID NOs. 1 to 250 can be identified by conducting a set of polymerase chain reactions (PCRs) using different probes selected from the probe set.

* * * * *